(12) United States Patent
Callen et al.

(10) Patent No.: US 7,407,677 B2
(45) Date of Patent: Aug. 5, 2008

(54) ENZYMES HAVING ALPHA AMYLASE ACTIVITY AND METHODS OF USE THEREOF

(75) Inventors: Walter Callen, San Diego, CA (US);
Toby Richardson, San Diego, CA (US);
Gerhard Frey, San Diego, CA (US);
Jay M. Short, Rancho Santa Fe, CA (US); Eric J. Mathur, Carlsbad, CA (US); Kevin A. Gray, San Diego, CA (US); Janne S. Kerovuo, San Diego, CA (US); Malgorzata Slupska, San Diego, CA (US)

(73) Assignee: Verenium Corporation, San Diego, CA (US)

( * ) Notice: Subject to any disclaimer, the term of this patent is extended or adjusted under 35 U.S.C. 154(b) by 0 days.

(21) Appl. No.: 10/081,872

(22) Filed: Feb. 21, 2002

(65) Prior Publication Data

US 2003/0125534 A1 Jul. 3, 2003

Related U.S. Application Data

(60) Provisional application No. 60/291,122, filed on May 14, 2001, provisional application No. 60/270,496, filed on Feb. 21, 2001, provisional application No. 60/270,495, filed on Feb. 21, 2001.

(51) Int. Cl.
*C12N 15/56* (2006.01)
*C12N 15/63* (2006.01)
*A23J 3/20* (2006.01)
*A23L 1/48* (2006.01)
*C12N 9/26* (2006.01)
*C12N 9/28* (2006.01)

(52) U.S. Cl. .......................... 426/7; 435/201; 435/202; 435/320.1; 435/252.3; 435/325; 435/254.11; 435/254.2; 435/419; 426/63; 536/23.2

(58) Field of Classification Search ................ 536/23.2, 536/23.1, 24.3, 24.32; 435/320.1, 252.3, 435/325, 202, 419, 254.2, 254.11

See application file for complete search history.

(56) References Cited

FOREIGN PATENT DOCUMENTS

| EP | 0648843 | 4/1995 |
|----|---------|--------|
| FR | 2778412 | 11/1999 |
| WO | 97/44361 | * 11/1997 |
| WO | WO 98/45417 | 10/1998 |

OTHER PUBLICATIONS

P. Bork, Genome Research, 10:348-400. (2000).*
F.J. Van de Loo et al., Proc. Natl. Acad. Sci. 92(15): 6743-6747. (Jul. 1995).*
P. Broun et al., Science 282:1315-1317. (Nov. 1998).*
J. Seffernick et al. Journal of Bacteriology, vol. 183(8): 2405-2410. (Apr. 2001).*
A. Witkowski et al., Biochemistry 38:1 1643-11650. (1999).*
H. Guo et al., "Protein Tolerance to Random Amino Acid Change", PNAS 101(25): 9205-9210. (Jun. 2004).*
Wong, et al., "Microassay for Rapid Screening of α-Amylase Activity", *J. Agric Food Chem.*, vol. 48, No. 10, pp. 4540-4543, Oct. 2000.
Fox, et al., "Miniaturization of Three Carbohydrate Analyses Using a Microsample Plate Reader", *Anal. Biochem.*, vol. 195, No. 1, pp. 93-96, May 15, 1991.
Tachibana, et al., "Cloning and Expression of the α-amylase Gene from the Hyperthermophilic Archaeon *Pyrococcus* sp. KOD1, and Characterization of the Enzyme", *Journal of Fermentation and Bioengineering*, vol. 82, No. 3, pp. 224-232, 1996.
Dong, et al., "Cloning, Sequencing, and Expression of the Gene Encoding Extracellular α-Amylase from *Pyrococcus furiousus* and Biochemical Characterization of the Recombinant Enzyme", *Applied and Environmental Microbiology*, vol. 63, No. 9, pp. 3569-3576, Sep. 1997.
Database GenBank, US National Library of Medicine (Bethesda, MD, USA), No. AAY53917, Leveque et al., Mar. 13, 2000.
Database GenBank, US National Library of Medicine (Bethesda, MD, USA), No. AAW26131, Imanaka, et al., Nov. 21, 1997.
Database GenBank, US National Library of Medicine (Bethesda, MD, USA), No. AAW34998, Lam, et al., May 21, 1998.
Database GenBank, US National Library of Medicine (Bethesda, MD, USA), No. AAR72603, Asada, et al., Oct. 25, 1995.
Database GenBank, US National Library of Medicine (Bethesda, MD, USA), No. AF068255, Leveque, et al., May 4, 2000.
Database GenBank, US National Library of Medicine (Bethesda, MD, USA), No. D83793, Tachibana, et al., Feb. 1, 2000.
Database GenBank, US National Library of Medicine (Bethesda, MD, USA), No. E13334, Imanaka, et al., Apr. 27, 1998.
Jorgensen et al. (1997). J. of Biol. Chem. 272(26):16335-16342.
Leveque et al. (2000). FEMS Microbiol. Letts. 186(1):67-71.
Patent Abstracts of Japan (1997). JP 9173077 A 1997(11).
Supplementary European Search Report mailed Sep. 6, 2004 for European patent application No. EP02706401, 5 pages.
Database Uniprot 'Online! (2000). Alpha amylase-pyrococcus woesei, XP002317659 retrieved from EBI, Database Accession No. Q9P9LO.
Jones et al. (1999). Journal of Applied Microbiology 86(1):93-107 XP002317658.
Supplementary Partial European Search Report mailed on Mar. 11, 2005, for European Patent application No. 02723192.7, based on PCT/US02/05068 filed on Feb. 21, 2002.
O'Neill et al., Mol. Gen. Genet. (1990) 221:235-244.

* cited by examiner

*Primary Examiner*—Rebecca Prouty
(74) *Attorney, Agent, or Firm*—Morrison & Foerster LLP

(57) ABSTRACT

The invention relates to alpha amylases and to polynucleotides encoding the alpha amylases. In addition methods of designing new alpha amylases and methods of use thereof are also provided. The alpha amylases have increased activity and stability at acidic, neutral and alkaline pH and increased temperature.

36 Claims, 116 Drawing Sheets

Figure 5: Residual activity of various amylases following heating to 90°C for 10 min.

Figure 6. Net percent starch removed vs. enzyme concentration in ADW wash test with bleach and chelators

Figure 7: Activity of parental amylases at pH 8, 40°C (black bars) in ADW formulation at 55°C (gray bars). Values are the average of 384 wells with error bars representing the standard deviation.

Figure 10: Alignments of the genes proposed to be used in reassembly

```
                   1                                                                              80
SEQ ID NO:114   (1) ----AANLNGTLMQYFEWYMPNDGQHWKRLQNDSAYLAEHGITAVWIPPAYKGTS-QADVGYGAYDLYDLGEFHQKGTVR
SEQ ID NO:128   (1) -QANTAPVNGTMMQYFEWDLPNDGTLWTKVKNEASSLSSLGITALWLPPAYKGTS-QGDVGYGVYDLYDLGEFNQKGTIR
SEQ ID NO:116   (1) AKYSELEQGGVIMQAFYWDVPEGGIWWDTIRQKIPEWYDAGISAIWIPPASKGMGGAYSMGYDPYDYFDLGEFYQKGTVE 81                                                                             160
SEQ ID NO:114  (76) TKYGTKGELQSAIKSLHSRDINVYGDVVINEKGCADATEDVTAVEVDPADRNRVISGEHRIKAWTHFHFPGRGSTYSDFK
SEQ ID NO:128  (79) TKYGTKTQYLQAIQAAKSAGMQVYADVVENEKAGADSTEWVDAVEVNPSNRNQETSGTYQIQAWTKFDFPGRGNTYSSFK
SEQ ID NO:116  (81) TRFGSKEELVNMISTAHQYGIKVIADIVINERAGGDLEWNPYVGDYTWTDFSKVASGKYKAFYMDFFPN----------

161                                                                            240
SEQ ID NO:114 (156) WHWYFFDGTDWDESRKLNRIYKFQG--KAWDWEVSNENGNYDYLMYADIDYDHPDVAAEIKRWGTWYANELQLDGFRLDA
SEQ ID NO:128 (159) WRWYFFDGTDWDESRKLNRIYKFRGTGKAWDWEVDTENGNYDYLMFADLDMDHPEVVTEIKNWGTWYVNTTNVDGFRIDA
SEQ ID NO:116 (150) ----NYSTSDEGTFGGFPDIDHLVPFNQYWLWASNFS-------------------------YAAYLRSIGIDAWREDY 241                                                                            320
SEQ ID NO:114 (234) VKHIKFSFLRDWVNHVREKTGKEMFTVAEYWQNDLGALENYLNKTNFNFSVFDVPLHYQFHAASTQGGGYDMRKLLNG--
SEQ ID NO:128 (239) VKHIKYSFFPDWLTHVRSQTRKNLFAVGEFWSYDVNKLHNYITKTSGTMSLFDAPLHNNFYTASKSSGYFDMRYLLNN--
SEQ ID NO:116 (200) VKGYGAWVVKDWLSQWGG------WAVGEYWDTNVDALLNWAYSSG--AKVFDFPLYYKMDEAFDNKNIPALVYAIQNGE 321                                                                            400
SEQ ID NO:114 (312) TVVSKHPLKAVTFVDNHDTQPGQSLESTVQTWFKPLAYAFILTRESGYPQVFYGDMYGTKGDSQ--REIPALKHKIEPIL
SEQ ID NO:128 (317) TLMKDQPSLAVTLVDNHDTQPGQSLQSWVEPWFKPLAYAFILTRQEGYPCVFYGDYYGIPKYN-----IPGLKSKIDPLL
SEQ ID NO:116 (272) TVVSRDPFKAVTFVANHDTN---------IIWNKYPAYAFILTYE-GQPVIFYRDYFEWLNKD--------KLNNL---I 401                                                                            480
SEQ ID NO:114 (390) KARKQYAYGAQHDYFDHFDIVGWTRFGDSSVANSGLAALITDGPGGAKRMYVGRQNAGETWFDITGNRS--EPVVINSEG
SEQ ID NO:128 (392) TARRDYAYGTQRDYIDHQDIIGWTRFGIDSKPNSGLAALITDGPGGSKWMYVGKKHAGKVFYDLTGNRS--DTVTINADG
SEQ ID NO:116 (331) WIHEFLACGSTKILYYDDDELIFMRFGYGDRPGL-ITYINLGSDWAERWVNVGSKFAGYTIFFYTGNLGCWVDRYVQYDG 481                                                                            560
SEQ ID NO:114 (468) WGEFKVN---------GGSVSIYVQR-----------------------------------------------------
SEQ ID NO:128 (470) WGEFKVN---------GGSVSIWVAKTSQVTFTVNNATTISGQNVYVVGNIPELGNWNTANAIKMTPSSYPTWKATIALP
SEQ ID NO:116 (410) WVKLTAPPHDPANGYYGYSVWSYAGVG----------------------------------------------------

561                                     605
SEQ ID NO:114 (485) ---------------------------------------
SEQ ID NO:128 (541) QGKAIEFKFIKKDQSGNVVWESIFNRTYTVPFLSTGSYTASWNVP
SEQ ID NO:116 (437) ---------------------------------------
```

Figure 11: Example Standard Curve of the assay of Example 5.
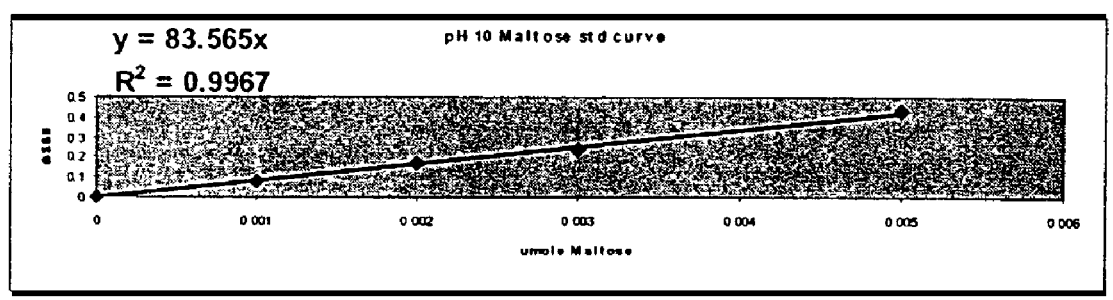

Figure 12: A graph of the pH rate profiles for 2 different amylases.
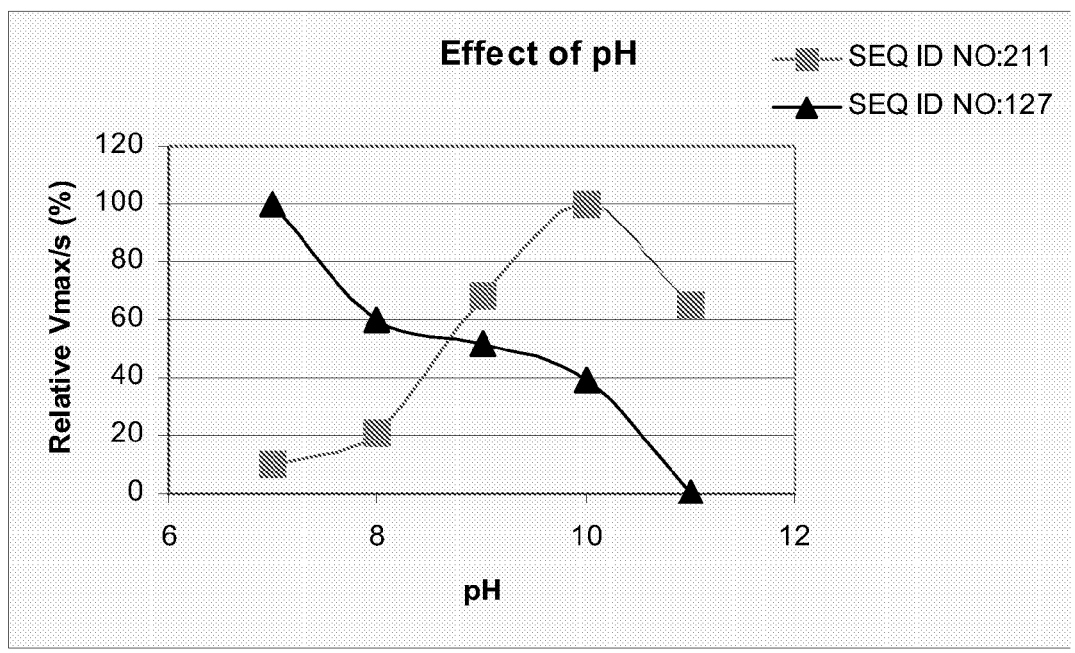

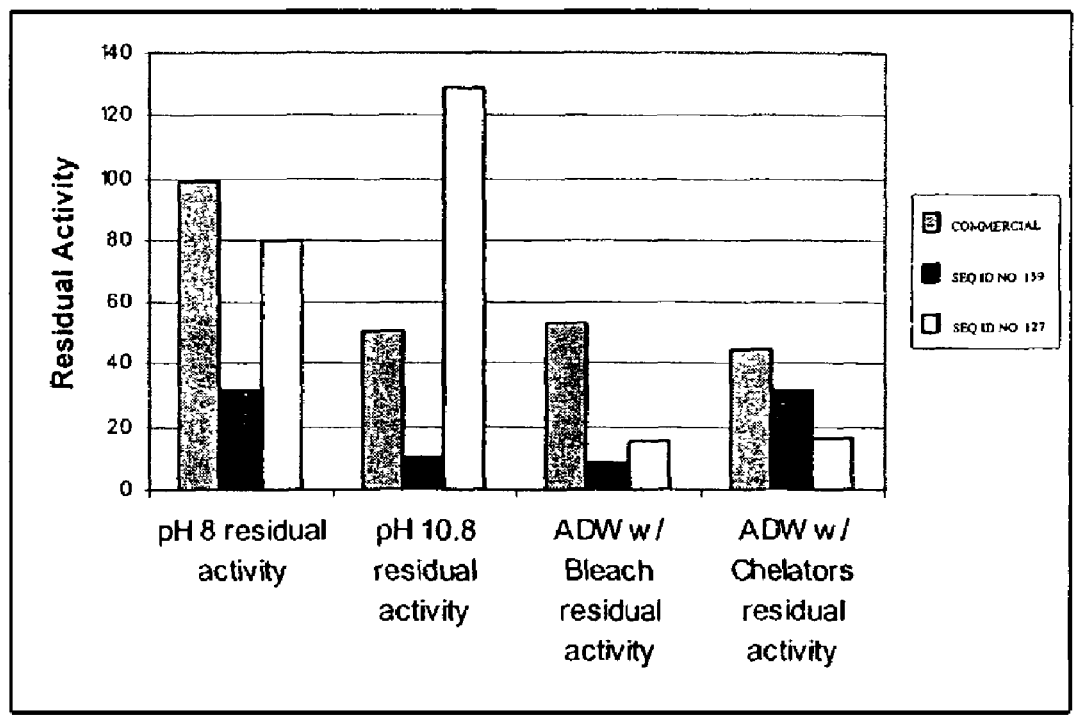
Figure 13: Stability of Diversa amylases vs. a commercial enzyme

```
                              1                                                    50
          SEQ ID NO 82         ---------- -------MKK FVALFITMFF VVSMAVV... ..AQPASAAK
      pyro (SEQ ID NO:313)     ---------- -------MKK FVALLITMFF VVSMAAV... ..AQPASAAK
      pyro2 (SEQ ID NO 314)    ---------- ------VNIKK LTPLLTLLLF FI...VL... ..ASPVSAAK
      thermo (SEQ ID NO 315)   SESQCTATCT WRVVYMSAKK LLALLFVLAV LVGVAVIPAR VGIAPVSAGA
      thermo2 (SEQ ID NO 316)  ---------- ---------- -------MA RKVLVALLVF LVVLSVSAVP
      Consensus (SEQ ID NO 317) ---------- ---------- ---------- ---------- ------SA--

51                                                   100
          SEQ ID NO 82         YS..ELEEGG VIMQAFYWDV PGGGIWWDTI RSKIPEWYEA GISAIWIPPA
      pyro (SEQ ID NO 313)     YS..ELEEGG VIMQAFYWDV PAGGIWWDTI RSKIPEWYEA GISAIWIPPA
      pyro2 (SEQ ID NO:314)    YL..ELEEGG VIMQAFYWDV PGGGIWWDHI RSKIPEWYEA GISAIWIPPA
      thermo (SEQ ID NO.315)   TSRPSLEEGG VIMQAFYWDV PAGGIWWDTI RSKIPDWASA GISAIWLPPP
      thermo2 (SEQ ID NO 316)  AKAETLENGG VIMQAFYWDV PGGGIWWDTI AQKIPDWASA GISAIWIPPA
      Consensus (SEQ ID NO 317) -----LE-GG VIMQAFYWDV P-GGIWWD-I --KIP-W--A GISAIW-PP-
                                 Sense primer
                              101                                                  150
          SEQ ID NO 82         SKGMSGGYSM GYDPYDFFDL GEYNQKGTIE TRFGSKQELI NMINTAHAYG
      pyro (SEQ ID NO:313)     SKGMGGAYSM GYDPYDFFDL GEYNQKGTVE TRFGSKQELI NMINTAHAYG
      pyro2 (SEQ ID NO 314)    SKGMSGGYSM GYDPYDYFDL GEYYQKGTVE TRFGSKEELV RLIQTAHAYG
      thermo (SEQ ID NO 315)   SKGMSGAYSM GYDPYDFFDL GEYYQKGTVE TRFGSKQELI NMINTAHSYG
      thermo2 (SEQ ID NO.316)  SKGMSGGYSM GYDPYDFFDL GEYYQKGSVE TRFGSKEELV NMINTAHAHN
      Consensus (SEQ ID NO 317) SKGM-G-YSM GYDPYD-FDL GEY-QKG--E TRFGSK-EL- --I-TAH---

151                                                  200
          SEQ ID NO:82         IKVIADIVIN HRAGGDLEWN PFVGDYTWTD FSKVASGKYT ANYLDFHPNE
      pyro (SEQ ID NO 313)     IKVIADIVIN HRAGGDLEWN PFVGDYTWTD FSKVASGKYT ANYLDFHPNE
      pyro2 (SEQ ID NO:314)    IKVIADVVIN HRAGGDLEWN PFVGDYTWTD FSKVASGKYT ANYLDFHPNE
      thermo (SEQ ID NO 315)   IKVIADIVIN HRAGGDLEWN PFTNSYTWTD FSKVASGKYT ANYLDFHPNE
      thermo2 (SEQ ID NO 316)  MKVIADIVIN HRAGGDLEWN PFTNSYTWTD FSKVASGKYT ANYLDFHPNE
      Consensus (SEQ ID NO:317) -KVIAD-VIN HRAGGDLEWN PF---YTWTD FSKVASGKYT ANYLDFHPNE 201                                                  250
          SEQ ID NO:82         VKCCDEGTFG GFPDIAHEKS WDQIIWLWASD ESYAAYLRSI GVDAWRFDYV
      pyro (SEQ ID NO:313)     VKCCDEGTFG GFPDIAHEKE WDQHWLWASD ESYAAYLRSI GVDAWRFDYV
      pyro2 (SEQ ID NO 314)    LHCCDEGTFG GFPDICHHKE WDQYWLWKSN ESYAAYLRSI GFDGWRFDYV
      thermo (SEQ ID NO 315)   VKCCDEGTFG GFPDIAHEKS WDQYWLWASQ KSYAAYLRSI GIDAWRFDYV
      thermo2 (SEQ ID NO:316)  LHAGDSGTFG GYPDICHDKS WDQHWLWASN ESYAAYLRSI GIDAWRFDYV
      Consensus (SEQ ID NO:317) ----D-GTFG G-PDI-H-K- WDQ-WLW-S- -SYAAYLRSI G-D-WRFDYV 251                                                  300
          SEQ ID NO:82         KGYGAWVVKD WLNWWGGWAV GEYWDTNVDA LLNWAYSSGA KVFDFPLYYK
      pyro (SEQ ID NO:313)     KGYGAWVVKD WLNWWGGWAV GEYWDTNVDA LLNWAYSSGA KVFDFPLYYK
      pyro2 (SEQ ID NO 314)    KGYGAWVVRD WLNWWGGWAV GEYWDTNVDA LLSWAYESGA KVFDFPLYYK
      thermo (SEQ ID NO:315)   KGYGAWVVKD WLKWW.ALAV GEYWDTNVDA LLNWAYSSGA KVFDFPLYYK
      thermo2 (SEQ ID NO:316)  KGYAPWVVKN WLNRWGGWAV GEYWDTNVDA LLSWAYDSGA KVFDFPLYYK
      Consensus (SEQ ID NO:317) KGY--WVV-- WL--W---AV GEYWDTNVDA LL-WAY-SGA KVFDFPLYYK 301                                                  350
          SEQ ID NO:82         MDEAFDNKNI PALVSALQNG QTVVSRDPFK AVTFVANHDT DIIWNKYLAY
      pyro (SEQ ID NO.313)     MDEAFDNTNI PALVDALQNG GTVVSRDPFK AVTFVANHDT DIIWNKYPAY
      pyro2 (SEQ ID NO:314)    MDEAFDNNNI PALVYALQNG QTVVSRDPFK AVTFVANHDT DIIWNKYPAY
      thermo (SEQ ID NO.315)   MDEAFDNKNI PALVSALQNG QTVVSRDPFK AVTFVANHDT DIIWNKYPAY
      thermo2 (SEQ ID NO.316)  MDEAFDNNNI PALVDALKNG GTVVSRDPFK AVTFVANHDT NIIWNKYPAY
      Consensus (SEQ ID NO 317) MDEAFDN-NI PALV-AL-NG -TVVSRDPFK AVTFVANHDT -IIWNKY-AY
```

Figure 14A-1

```
                                            351                                                          400
            SEQ ID NO 82            AFILT YEGQP  VIFYRD YEEW  LNKDRLN NLI  WIHDHLAG GS  TSIVYYDSD E
       pyro (SEQ ID NO 313)         AFILT YEGQP  VIFYRD YEEW  LNKDKLN NLI  WIHDHLAG GS  TSIVYYDSD E
       pyro2 (SEQ ID NO 314)        AFILT YEGQP  VIFYRD FEEW  LNKDKLI NLI  WIHDHLAG GS  TTIVYYDND E
       thermo (SEQ ID NO:315)       AFILT YEGQP  VIFYRD YEEW  LNKDRLK NLI  WIHNNLAG GS  TSIVYYDND E
       thermo2 (SEQ ID NO 316)      AFILT YEGQP  AIFYRD YEEW  LNKDRLR NLI  WIHDHLAG GS  TDIIYYDSD E
       Consensus (SEQ ID NO:317)    AFILT YEGQP  -IFYRD -EEW  LNKD-L- NLI  WIH--LAG GS  T-I-YYD-D E 401                                                          450
            SEQ ID NO 82            MIFVR NGYGS  KPGLIT YINL  GSSKVGR WVY  VPKFAGAC IH  EYTGNLGGW V
       pyro (SEQ ID NO:313)         LIFVR NGDSK  RPGLIT YINL  GSSKVGR WVY  VPKFAGAC IH  EYTGNLGGW V
       pyro2 (SEQ ID NO:314)        LIFVR NGDSR  RPGLIT YINL  SPNWVGR WVY  VPKFAGAC IH  EYTGNLGGW V
       thermo (SEQ ID NO:315)       LIFVR NGYGN  KPGLIT YINL  GSSKVGR WVY  VPKFAGSC IH  EYTGNLGGW V
       thermo2 (SEQ ID NO 316)      LIFVR NGYGD  KPGLIT YINL  GSSKAGR WVY  VPKFAGSC IH  EYTGNLGGW I
       Consensus (SEQ ID NO 317)    -IFVR NG---  -PGLIT YINL  -----GR WVY  VPKFAG-C IH  EYTGNLGGW -

451                                            486
            SEQ ID NO 82            DKYVY SSGWV  YFEAPA YDPA  NGQYGYS VWS  YCGVG*
       pyro (SEQ ID NO:313)         DKYVE SSGWV  YLEAPA YDPA  SGQYGYT VWS  YCGVG*
       pyro2 (SEQ ID NO:314)        DKRVD SSGWV  YLEAPP HDPA  NGYYGYS VWS  YCGVG*
       thermo (SEQ ID NO:315)       DKYVG SNGWV  YLEAPA HDPA  KGQYGYS VWS  YCGVG*
       thermo2 (SEQ ID NO:316)      DKWVD SSGRV  YLEAPA HDPA  NGQYGYS VWS  YCGVG*
       Consensus (SEQ ID NO.317)    DK-V- S-G-V  Y-EAP- -DPA  -G-YGY- VWS  YCGVG*
                                                                       Antisense primer
```

Figure 14A-2

|  | 1 | | | | 50 |
|---|---|---|---|---|---|
| SEQ ID NO:82 | ---------- | ---------- | ----MKKFVA | LFITMFFVVS | MAVVAQPASA |
| pyro (SEQ ID NO:313) | ---------- | ---------- | ----MKKFVA | LLITMFFVVS | MAAVAQPASA |
| SEQ ID NO:74 | ---------- | ---------- | ---------- | ---------- | ---------- |
| thermo2 (SEQ ID NO:316) | ---------- | ---------- | --------MA | RKVLVALLVF | LVVLSVSAVP |
| SEQ ID NO:76 | ---------- | ---------- | ---------- | ---------- | ---------- |
| SEQ ID NO:78 | ---------- | ---------- | ---------- | ---------- | ---------- |
| SEQ ID NO:84 | ---------- | ---------- | ---------- | ---------- | ---------- |
| SEQ ID NO:86 | ---------- | ---------- | ---------- | ---------- | ---------- |
| SEQ ID NO:80 | ---------- | ---------- | ----MKPAKL | LVFVLVVSIL | AGLYAQPAGA |
| thermo (SEQ ID NO:315) | SESQCTATCT | WRVVYMSAKK | LLALLFVLAV | LVGVAVIPAR | VGIAPVSAGA |
| pyro2 (SEQ ID NO:314) | ---------- | ---------- | -----VNIKK | LTPLLTLLLF | FIVLASPVSA |
| CLONE A (SEQ ID NO:318) | ---------- | ---------- | ---MRRSARV | LVLIIAFFLL | AGIYYPSTSA |
| Consensus (SEQ ID NO:319) | ---------- | ---------- | ---------- | ---------- | ---------- |

|  | 51 | | | | 100 |
|---|---|---|---|---|---|
| SEQ ID NO:82 | AKYSELEEGG | VIMQAFYWDV | PGGGIWWDTI | RSKIPEWYEA | GISAIWIPPA |
| pyro (SEQ ID NO:313) | AKYSELEEGG | VIMQAFYWDV | PAGGIWWDTI | RSKIPEWYEA | GISAIWIPPA |
| SEQ ID NO:74 | ---MALEEGG | LIMQAFYWDV | PGGGIWWDTI | AQKIPDWASA | GISAIWIPPA |
| thermo2 (SEQ ID NO:316) | AKAETLENGG | VIMQAFYWDV | PGGGIWWDTI | AQKIPDWASA | GISAIWIPPA |
| SEQ ID NO:76 | ---MALEEGG | LIMQAFYWDV | PMGGIWWDTI | AQKIPDWASA | GISAIWIPPA |
| SEQ ID NO:78 | ---MALEEGG | LIMQAFYWDV | PMGGIWWDTI | AQKIPDWASA | GISAIWIPPA |
| SEQ ID NO:84 | ---MALEEGG | LIMQAFYWDV | PGGGIWWDTI | AQKIPEWASA | GISAIWIPPA |
| SEQ ID NO:86 | ---MALEEGG | LIMQAFYWDV | PGGGIWWDTI | AQKIPEWASA | GISAIWIPPA |
| SEQ ID NO:80 | AKYLELEEGG | VIMQAFYWDV | PSGGIWWDTI | RQKIPEWYDA | GISAIWIPPA |
| thermo (SEQ ID NO:315) | TSRPSLEEGG | VIMQAFYWDV | PAGGIWWDTI | RSKIPDWASA | GISAIWIPPA |
| pyro2 (SEQ ID NO:314) | AKYLELEEGG | VIMQAFYWDV | PGGGIWWDHI | RSKIPEWYEA | GISAIWLPPP |
| CLONE A (SEQ ID NO:318) | AKYSELEQGG | VIMQAFYWDV | PEGGIWWDTI | RQKIPEWYDA | GISAIWIPPA |
| Consensus (SEQ ID NO:319) | --------GG | -IMQAFYWDV | P-GGIWWD-I | --KIP-W--A | GISAIW-PP- |

|  | 101 | | | | 150 |
|---|---|---|---|---|---|
| SEQ ID NO:82 | SKGMSGGYSM | GYDPYDFFDL | GEYNQKGTIE | TRFGSKQELI | NMINTAHAYG |
| pyro (SEQ ID NO:313) | SKGMGGAYSM | GYDPYDFFDL | GEYNQKGTVE | TRFGSKQELI | NMINTAHAYG |
| SEQ ID NO:74 | SKGMSGGYSM | GYDPYDFFDL | GEYYQKGSVE | TRFGSKEELV | NMINTAHAHN |
| thermo2 (SEQ ID NO:316) | SKGMSGGYSM | GYDPYDFFDL | GEYYQKGSVE | TRFGSKEELV | NMINTAHAHN |
| SEQ ID NO:76 | SKGMSGGYSM | GYDPYDYFDL | GEYYQKGTVE | TRFGSKQELI | NMINTAHAYG |
| SEQ ID NO:78 | SKGMSGGYSM | GYDPYDYFDL | GEYYQKGTVE | TRFGSKQELI | NMINTAHAYG |
| SEQ ID NO:84 | SKGMSGGYSM | GYDPYDFFDL | GEYYQKGTVE | TRFGSKEELV | NMINTAHSYG |
| SEQ ID NO:86 | SKGMSGGYSM | GYDPYDFFDL | GEYYQKGTVE | TRFGSKEELV | NMINTAHSYG |
| SEQ ID NO:80 | SKGMGGAYSM | GYDPYDFFDL | GEYDQKGTVE | TRFGSKQELV | NMINTAHAYG |
| thermo (SEQ ID NO:315) | SKGMSGAYSM | GYDPYDFFDL | GEYYQKGTVE | TRFGSKQELI | NMINTAHSYG |
| pyro2 (SEQ ID NO:314) | SKGMSGGYSM | GYDPYDYFDL | GEYYQKGTVE | TRFGSKEELV | RLIQTAHAYG |
| CLONE A (SEQ ID NO:318) | SKGMGGAYSM | GYDPYDYFDL | GEFYQKGTVE | TRFGSKEELV | NMISTAHQYG |
| Consensus (SEQ ID NO:319) | SKGM-G-YSM | GYDPYD-FDL | GE--QKG--E | TRFGSK-EL- | --I-TAH--- |

|  | 151 | | | | 200 |
|---|---|---|---|---|---|
| SEQ ID NO:82 | IKVIADIVIN | HRAGGDLEWN | PFVGDYTWTD | FSKVASGKYT | ANYLDFHPNE |
| pyro (SEQ ID NO:313) | IKVIADIVIN | HRAGGDLEWN | PFVGDYTWTD | FSKVASGKYT | ANYLDFHPNE |
| SEQ ID NO:74 | MKVIADIVIN | HRAGGDLEWN | PFTNSYTWTD | FSKVASGKYT | ANYLDFHPNE |
| thermo2 (SEQ ID NO:316) | MKVIADIVIN | HRAGGDLEWN | PFTNSYTWTD | FSKVASGKYT | ANYLDFHPNE |
| SEQ ID NO:76 | MKVIADIVIN | HRAGGDLEWN | PFVNDYTWTD | FSKVASGKYT | ANYLDFHPNE |
| SEQ ID NO:78 | MKVIADIVIN | HRAGGDLEWN | PFVNDYTWTD | FSKVASGKYT | ANYLDFHPNE |
| SEQ ID NO:84 | IKVIADIVIN | HRAGGDLEWN | PFVNDYTWTD | FSKVASGKYT | ANYLDFHPNE |
| SEQ ID NO:86 | IKVIADIVIN | HRAGGGLEWN | PFVNDYTWTD | FSKVASGKYT | ANYLDFHPNE |
| SEQ ID NO:80 | IKVIADIVIN | HRAGGDLEWN | PFVNDYTWTD | FSKVASGKYT | ANYLDFHPNE |
| thermo (SEQ ID NO:315) | IKVIADIVIN | HRAGGDLEWN | PFTNSYTWTD | FSKVASGKYT | ANYLDFHPNE |
| pyro2 (SEQ ID NO:314) | IKVIADVVIN | HRAGGDLEWN | PFVGDYTWTD | FSKVASGKYT | ANYLDFHPNE |
| CLONE A (SEQ ID NO:318) | IKVIADIVIN | HRAGGDLEWN | PYVGDYTWTD | FSKVASGKYK | AHYMDFHPNN |
| Consensus (SEQ ID NO:319) | -KVIAD-VIN | HRAGG-LEWN | P----YTWTD | FSKVASGKY- | A-Y-DFHPN- |

Figure 14B-1

```
                                  201                                                               250
              SEQ ID NO:82        VKCCD EGTFG  GFPDIA HEKS  WDQHWLW ASD  ESYAAYLR SI  GVDAWRFDY V
         pyro (SEQ ID NO:313)     VKCCD EGTFG  GFPDIA HEKE  WDQHWLW ASD  ESYAAYLR SI  GVDAWRFDY V
              SEQ ID NO:74        LHAGD SGTFG  GYPDIC HDKS  WDQHWLW ASN  ESYAAYLR SI  GIDAWRFDY V
       thermo2 (SEQ ID NO:316)    LHAGD SGTFG  GYPDIC HDKS  WDQHWLW ASN  ESYAAYLR SI  GIDAWRFDY V
              SEQ ID NO:76        LHAGD SGTFG  GYPDIC HDKS  WDQYWLW ASQ  ESYAAYLR SI  GIDAWRFDY V
              SEQ ID NO:78        LHAGD SGTFG  GYPDIC HDKS  WDQYWLW ASQ  ESYAAYLR SI  GIDAWRFDY V
              SEQ ID NO:84        LHCCD EGTFG  GYPDIC HDKS  WDQYWLW ASS  ESYAAYLR SI  GVDAWRFDY V
              SEQ ID NO:86        LHCCD EGTFG  GYPDIC HDKS  WDQYWLW ASS  ESYAAYLR SI  GVDAWCFDY V
              SEQ ID NO:80        VKCCD EGTFG  GFPDIA HEKS  WDQYWLW ASN  ESYAAYLR SI  GVDAWRFDY V
        thermo (SEQ ID NO:315)    VKCCD EGTFG  GFPDIA HEKS  WDQYWLW ASQ  KSYAAYLR SI  GIDAWRFDY V
         pyro2 (SEQ ID NO:314)    LHCCD EGTFG  GFPDIC HHKE  WDQYWLW KSN  ESYAAYLR SI  GFDGWRFDY V
       CLONE A (SEQ ID NO:318)    YSTSD EGTFG  GFPDID HLVP  FNQYWLW ASN  ESYAAYLR SI  GIDAWRFDY V
     Consensus (SEQ ID NO:319)    ----D -GTFG  G-PDI- H---  --Q-WLW -S-  -SYAAYLR SI  G-D-W-FDY V 251                                                               300
              SEQ ID NO:82        KGYGA WVVKD  WLNWWG GWAV  GEYWDTN VDA  LLNWAYSS GA  KVFDFPLYY K
         pyro (SEQ ID NO:313)     KGYGA WVVKD  WLNWWG GWAV  GEYWDTN VDA  LLNWAYSS GA  KVFDFPLYY K
              SEQ ID NO:74        KGYAP WVVKN  WLNRWG GWAV  GEYWDTN VDA  LLSWAYDS GA  KVFDFPLYY K
       thermo2 (SEQ ID NO:316)    KGYAP WVVKN  WLNRWG GWAV  GEYWDTN VDA  LLSWAYDS GA  KVFDFPLYY K
              SEQ ID NO:76        KGYAP WVVRD  WLNWWG GWAV  GEYWDTN VDA  VLNWAYSS GA  KVFDFALYY K
              SEQ ID NO:78        KGYAP WVVKD  WLNWWG GWAV  GEYWDTN VDA  VLNWAYSS GA  KVFDFALYY K
              SEQ ID NO:84        KGYGA WVVND  WLSWWG GWAV  GEYWDTN VDA  LLNWAYSS GA  KVFDFPLYY K
              SEQ ID NO:86        KGYGA WVVND  WLSWWG GWAV  GEYWDTN VDA  LLNWAYNS GA  KVFDFPLYY K
              SEQ ID NO:80        KGYGA WVVKD  WLDWWG GWAV  GEYWDTN VDA  LLNWAYSS DA  KVFDFPLYY K
        thermo (SEQ ID NO:315)    KGYGA WVVKD  WLKWW. ALAV  GEYWDTN VDA  LLNWAYSS GA  KVFDFPLYY K
         pyro2 (SEQ ID NO:314)    KGYGA WVVRD  WLNWWG GWAV  GEYWDTN VDA  LLSWAYES GA  KVFDFPLYY K
       CLONE A (SEQ ID NO:318)    KGYGA WVVKD  WLSQWG GWAV  GEYWDTN VDA  LLNWAYSS GA  KVFDFPLYY K
     Consensus (SEQ ID NO:319)    KGY-- WVV--  WL--W- --AV  GEYWDTN VDA  -L-WAY-S -A  KVFDF-LYY K 301                                                               350
              SEQ ID NO:82        MDEAF DNKNI  PALVSA LQNG  QTVVSRD PFK  AVTFVANH DT  DIIWNKYLA Y
         pyro (SEQ ID NO:313)     MDEAF DNTNI  PALVDA LQNG  GTVVSRD PFK  AVTFVANH DT  DIIWNKYPA Y
              SEQ ID NO:74        MDEAF DNNNI  PALVDA LKNG  GTVVSRD PFK  AVTFVANH DT  NIIWNKYPA Y
       thermo2 (SEQ ID NO:316)    MDEAF DNNNI  PALVDA LKNG  GTVVSRD PFK  AVTFVANH DT  NIIWNKYPA Y
              SEQ ID NO:76        MDEAF DNNNI  PALVDA LRYG  QTVVSRD PFK  AVTFVANH DT  DIIWNKYPA Y
              SEQ ID NO:78        MDEAF DNNNI  PALVDA LRYG  QTVVSRD PFK  AVTFVANH DT  DIIWNKYPA Y
              SEQ ID NO:84        MDEAF DNTNI  PALVDA LRYG  QTVVSRD PFK  AVTFVANH DT  DIIWNKYPA Y
              SEQ ID NO:86        MDEAF DNTNI  PALVYA LKNG  GTVVSRD PFK  AVTFVANH DT  DITWNKYPA Y
              SEQ ID NO:80        MDAAF DNKNI  PALVEA LKNG  GTVVSRD PFK  AVTFVANH DT  DIIWNKYPA Y
        thermo (SEQ ID NO:315)    MDEAF DNKNI  PALVSA LQNG  QTVVSRD PFK  AVTFVANH DT  DIIWNKYPA Y
         pyro2 (SEQ ID NO:314)    MDEAF DNNNI  PALVYA LQNG  QTVVSRD PFK  AVTFVANH DT  DIIWNKYPA Y
       CLONE A (SEQ ID NO:318)    MDEAF DNKNI  PALVYA IQNG  ETVVSRD PFK  AVTFVANH DT  NIIWNKYPA Y
     Consensus (SEQ ID NO:319)    MD-AF DN-NI  PALV-A ---G  -TVVSRD PFK  AVTFVANH DT  -IIWNKY-AY 351                                                               400
              SEQ ID NO:82        AFILT YEGQP  VIFYRD YEEW  LNKDRLN NLI  WIHDHLAG GS  TSIVYYDSD E
         pyro (SEQ ID NO:313)     AFILT YEGQP  VIFYRD YEEW  LNKDKLN NLI  WIHDHLAG GS  TSIVYYDSD E
              SEQ ID NO:74        AFILT YEGQP  AIFYRD YEEW  LNKDRLR NLI  WIHDHLAG GS  TDIIYYDSD E
       thermo2 (SEQ ID NO:316)    AFILT YEGQP  AIFYRD YEEW  LNKDRLR NLI  WIHDHLAG GS  TDIIYYDSD E
              SEQ ID NO:76        AFILT YEGQP  TIFYRD YEEW  LNKDKLK NLI  WIHDNLAG GS  TDIVYYDND E
              SEQ ID NO:78        AFILT YEGQP  TIFYRD YEEW  LNKDKLK NLI  WIHDNLAG GS  TDIVYYDND E
              SEQ ID NO:84        AFILT YEGQP  VIFYRD YEEW  LNKDKLN NLI  WIHDHLAG GS  TDIVYYDSD E
              SEQ ID NO:86        AFILT YEGQP  VIFYRD YEEW  LNKDKLN NLI  WIHDHLAG GS  TDIVYYDSD E
              SEQ ID NO:80        AFILT YEGQP  TIFYRD YEEW  LNKDRLK NLI  WIHDHLAG GS  TDIVYYDND E
        thermo (SEQ ID NO:315)    AFILT YEGQP  VIFYRD YEEW  LNKDRLK NLI  WIHNNLAG GS  TSIVYYDND E
         pyro2 (SEQ ID NO:314)    AFILT YEGQP  VIFYRD FEEW  LNKDKLI NLI  WIHDHLAG GS  TTIVYYDND E
       CLONE A (SEQ ID NO:318)    AFILT YEGQP  VIFYRD YEEW  LNKDKLN NLI  WIHEHLAG GS  TKILYYDDD E
     Consensus (SEQ ID NO:319)    AFILT YEGQP  -IFYRD -EEW  LNKD-L- NLI  WIH--LAG GS  T-I-YYD-D E
```

Figure 14B-2

```
                                401                                                           450
       SEQ ID NO:82     MIFVR NGYGS KPGLIT YINL GSSKVGR WVY V.PKFAGA CI HEYTGNLGG W
    pyro (SEQ ID NO.313) LIFVR NGDSK RPGLIT YINL GSSKVGR WVY V.PKFAGA CI HEYTGNLGG W
       SEQ ID NO:74     LIFVR NGYGD KPGLIT YINL GSSKAGR WVY V.PKFAGS CI HEYTGNLGG W
  thermo2 (SEQ ID NO:316) LIFVR NGYGD KPGLIT YINL GSSKAGR WVY V.PKFAGS CI HEYTGNLGG W
       SEQ ID NO:76     LIFVR NGYGS KPGLIT YINL GSSKAGR WVY V.PKFAGS CI HEYTGNLGG W
       SEQ ID NO:78     LIFVR NGYGS KPGLIT YINL ASSKAGR WVY V.PKFAGS CI HEYTGNLGG W
       SEQ ID NO:84     LIFVR NGYGT KPGLIT YINL GSSKVGR WVY V.PKFAGS CI HEYTGNLGG W
       SEQ ID NO:86     LIFVR NGYGT KPGLIT YINL GSSKAGR WVY V.PKFAGS CI HEYTGSLGG W
       SEQ ID NO:80     LIFVR NGYGD KPGLIT YINL GSSKAGR WVY V.PKFAGA CI HEYTGNLGG W
   thermo (SEQ ID NO:315) LIFVR NGYGN KPGLIT YINL GSSKVGR WVY V.PKFAGS CI HEYTGNLGG W
    pyro2 (SEQ ID NO:314) LIFVR NGDSR RPGLIT YINL SPNWVGR WVY V.PKFAGA CI HEYTGNLGG W
   CLONE A (SEQ ID NO:318) LIFMR EGYGD RPGLIT YINL GSDWAER WVN VGSKFAGY TI HEYTGNLGG W
  Consensus (SEQ ID NO:319) -IF-R -G--- -PGLIT YINL ------R WV- V--KFAG- -I HEYTG-LGG W 451                                    487
       SEQ ID NO:82     VDKYV YSSGW VYFEAP AYDP ANGQYGY SVW SYCGVG*
    pyro (SEQ ID NO:313) VDKYV ESSGW VYLEAP AYDP ASGQYGY TVW SYCGVG*
       SEQ ID NO:74     IDKWV DSSGR VYLEAP AHDP ANGQYGY SVW SYCGVG*
  thermo2 (SEQ ID NO:316) IDKWV DSSGR VYLEAP AHDP ANGQYGY SVW SYCGVG*
       SEQ ID NO:76     VDKWV DSSGW VYLEAP AHDP ANGQYGY SVW SYCGVG*
       SEQ ID NO:78     VDKWV DSSGW VYLEAP AHDP ANGQYGY SVW SYCGVG*
       SEQ ID NO:84     IDKYV SSSGW VYLEAP AHDP ANGYYGY SVW SYCGVG*
       SEQ ID NO:86     IDKYV SSSGW VYLEAP AHDP ANGQYGY SVW SYCGVG*
       SEQ ID NO:80     VDKWV DSSGW VYLEAP AHDP ANGYYGY SVW SYCGVG*
   thermo (SEQ ID NO:315) VDKYV GSNGW VYLEAP AHDP AKGQYGY SVW SYCGVG*
    pyro2 (SEQ ID NO:314) VDKRV DSSGW VYLEAP PHDP ANGYYGY SVW SYCGVG*
   CLONE A (SEQ ID NO:318) VDRYV QYDGW VKLTAP PHDP ANGYYGY SVW SYAGVG*
  Consensus (SEQ ID NO:319) -D--V ---G- V---AP --DP A-G-YGY -VW SY-GVG*
```

Figure 14B-3

|   | 1 | | | | 50 |
|---|---|---|---|---|---|
| SEQ ID NO:83 | ---------- | ---------- | ---------- | ---------- | ---------- |
| SEQ ID NO:85 | ---------- | ---------- | ---------- | ---------- | ---------- |
| SEQ ID NO:75 | ---------- | ---------- | ---------- | ---------- | ---------- |
| SEQ ID NO:77 | ---------- | ---------- | ---------- | ---------- | ---------- |
| SEQ ID NO:73 | ---------- | ---------- | ---------- | ---------- | ---------- |
| SEQ ID NO:79 | ---ATGA AGC | CTGCGAAA CT | CCTCGTCTT T | GTGCTCGTAG | TCTCTATCCT |
| SEQ ID NO:81 | ---ATGA AGA | AGTTTGTC GC | CCTGTTCAT A | ACCATGTTTT | TCGTAGTGAG |
| CLONE A (SEQ ID NO:320) | ATGAGGA GAT | CCGCAAGG GT | TTTGGTTCT G | ATTATAGCGT | TTTTCCTCCT |
| Consensus (SEQ ID NO:321) | ---------- | ---------- | ---------- | ---------- | ---------- |

|   | 51 | | | | 100 |
|---|---|---|---|---|---|
| SEQ ID NO:83 | ---------- | ---------- | ---------- | ---------- | ATGGCTCTGG |
| SEQ ID NO:85 | ---------- | ---------- | ---------- | ---------- | ATGGCTCTGG |
| SEQ ID NO:75 | ---------- | ---------- | ---------- | ---------- | ATGGCTCTGG |
| SEQ ID NO:77 | ---------- | ---------- | ---------- | ---------- | ATGGCTCTGG |
| SEQ ID NO:73 | ---------- | ---------- | ---------- | ---------- | ATGGCTCTGG |
| SEQ ID NO:79 | CGCGGGG CTC | TACGCCCA GC | CCGCGGGG C | GGCCAAGTAC | CTGGAGCTCG |
| SEQ ID NO:81 | CATGGCA GTC | GTTGCACA GC | CAGCTAGCG C | CGCAAAGTAT | TCCGAGCTCG |
| CLONE A (SEQ ID NO:320) | GGCGGGG ATT | TACTACCC CT | CCACGAGTG C | CGCGAAGTAC | TCCGAGCTGG |
| Consensus (SEQ ID NO:321) | ---------- | ---------- | ---------- | ---------- | ---------- |

|   | 101 | | | | 150 |
|---|---|---|---|---|---|
| SEQ ID NO:83 | AAGAGGG CGG | GCTCATAA TG | CAGGCCTTC T | ACTGGGATGT | TCCTGGAGGA |
| SEQ ID NO:85 | AAGAGGG CGG | GCTTATAA TG | CAGGCATTC T | ATTGGGACGT | CCCAGGTGGA |
| SEQ ID NO:75 | AAGAGGG CGG | GCTTATAA TG | CAGGCATTC T | ACTGGGACGT | CCCCATGGGA |
| SEQ ID NO:77 | AAGAGGG CGG | GCTCATAA TG | CAGGCCTTC T | ACTGGGACGT | CCCCATGGGA |
| SEQ ID NO:73 | TAGAGGG CGG | GCTTATAA TG | CAGGCCTTC T | ACTGGGACGT | CCCAGGTGGA |
| SEQ ID NO:79 | AAGAGGG CGG | CGTCATAA TG | CAGGCGTTC T | ACTGGGACGT | GCCTTCAGGA |
| SEQ ID NO:81 | AAGAAGG CGG | CGTTATAA TG | CAGGCCTTC T | ACTGGGACGT | CCCAGGTGGA |
| CLONE A (SEQ ID NO:320) | AGCAGGG CGG | AGTCATAA TG | CAGGCCTTC T | ACTGGGACGT | TCCGGAGGGA |
| Consensus (SEQ ID NO:321) | -----GG CGG | --T-ATAA TG | CAGGC-TTC T | A-TGGGA-GT | -CC----GGA |

|   | 151 | | | | 200 |
|---|---|---|---|---|---|
| SEQ ID NO:83 | GGAATCT GGT | GGGACACA AT | AGCTCAAAA G | ATACCCGAAT | GGGCAAGTGC |
| SEQ ID NO:85 | GGAATCT GGT | GGGACACC AT | AGCCCAGAA G | ATACCCGAAT | GGGCAAGTGC |
| SEQ ID NO:75 | GGAATCT GGT | GGGACACG AT | AGCCCAGAA G | ATACCCGACT | GGGCAAGCGC |
| SEQ ID NO:77 | GGAATCT GGT | GGGACACG AT | AGCCCAGAA G | ATACCCGACT | GGGCAAGCGC |
| SEQ ID NO:73 | GGAATCT GGT | GGGACACC AT | AGCCCAGAA G | ATACCCGACT | GGGCGAGCGC |
| SEQ ID NO:79 | GGAATAT GGT | GGGACACA AT | ACGGCAGAA G | ATACCGGAGT | GGTACGATGC |
| SEQ ID NO:81 | GGAATCT GGT | GGGACACC AT | CAGGAGCAA G | ATACCGGAGT | GGTACGAGGC |
| CLONE A (SEQ ID NO:320) | GGAATCT GGT | GGGACACA AT | ACGGCAGAA G | ATCCCTGAAT | GGTACGATGC |
| Consensus (SEQ ID NO:321) | GGAAT-T GGT | GGGACAC- AT | -------AAG | AT-CC-GA-T | GG------GC |

|   | 201 | | | | 250 |
|---|---|---|---|---|---|
| SEQ ID NO:83 | AGGAATC TCA | GCGATATG GA | TTCCACCAG C | GAGTAAGGGC | ATGAGCGGTG |
| SEQ ID NO:85 | AGGAATC TCA | GCGATATG GA | TTCCACCAG C | GAGTAAGGGA | ATGAGCGGTG |
| SEQ ID NO:75 | CGGGATT TCG | GCGATATG GA | TTCCCCCG C | GAGCAAGGGT | ATGAGCGGCG |
| SEQ ID NO:77 | CGGGATT TCG | GCGATATG GA | TCCCTCCCG C | GAGCAAGGGT | ATGAGCGGCG |
| SEQ ID NO:73 | CGGGATT TCG | GCAATATG GA | TTCCTCCCG C | GAGTAAGGGC | ATGAGCGGCG |
| SEQ ID NO:79 | CGGAATC TCC | GCAATATG GA | TTCCCCCGG C | GAGCAAGGGC | ATGGGCGGCG |
| SEQ ID NO:81 | GGGAATA TCC | GCCATTTG GA | TTCCGCCAG C | CAGCAAGGGG | ATGAGCGGCG |
| CLONE A (SEQ ID NO:320) | AGGCATA TCC | GCCATCTG GA | TACCCCCGG C | GAGCAAGGGC | ATGGGCGGGG |
| Consensus (SEQ ID NO:321) | -GG-AT- TC- | GC-AT-TG GA | T-CC-CC-G C | -AG-AAGGG- | ATG-GCGG-G |

Figure 14C-1

|                              | 251         |            |            |            | 300        |
|------------------------------|-------------|------------|------------|------------|------------|
| SEQ ID NO:83                 | GTTATTC CAT | GGGCTACG AT | CCCTACGAT T | TCTTTGACCT | CGGCGAGTAC |
| SEQ ID NO:85                 | GTTATTC CAT | GGGCTACG AT | CCCTACGAT T | TCTTTGACCT | CGGCGAGTAC |
| SEQ ID NO:75                 | GCTATTC GAT | GGGCTACG AC | CCCTACGAT T | ATTTTGACCT | CGGTGAGTAC |
| SEQ ID NO:77                 | GCTATTC GAT | GGGCTACG AC | CCCTACGAT T | ATTTTGACCT | CGGTGAGTAC |
| SEQ ID NO:73                 | GCTATTC GAT | GGGCTACG AC | CCCTACGAT T | TCTTCGACCT | CGGTGAGTAC |
| SEQ ID NO:79                 | CCTATTC GAT | GGGCTACG AC | CCCTACGAC T | TCTTTGACCT | CGGTGAGTAC |
| SEQ ID NO:81                 | GTTACTC GAT | GGGCTACG AT | CCCTACGAT T | TCTTTGACCT | CGGCGAGTAC |
| CLONE A (SEQ ID NO:320)      | CCTACTC GAT | GGGCTACG AC | CCCTACGAT T | ACTTCGATCT | GGGCGAGTTT |
| Consensus (SEQ ID NO:321)    | --TA-TC -AT | GGGCTACG A- | CCCTACGA- T | --TT-GA-CT | -GG-GAGT-- |

|                              | 301         |            |            |            | 350        |
|------------------------------|-------------|------------|------------|------------|------------|
| SEQ ID NO:83                 | TATCAGA AGG | GGACAGTT GA | GACGCGCTT C | GGCTCAAAGG | AAGAACTGGT |
| SEQ ID NO:85                 | TATCAGA AGG | GGACAGTT GA | GACGCGCTT C | GGCTCAAAGG | AAGAACTGGT |
| SEQ ID NO:75                 | TACCAGA AGG | GAACGGTG GA | AACAAGATT C | GGCTCAAAGC | AGGAGCTCAT |
| SEQ ID NO:77                 | TACCAGA AGG | GAACGGTG GA | AACGAGGTT C | GGCTCAAAGC | AGGAGCTCAT |
| SEQ ID NO:73                 | TACCAGA AGG | GAAGCGTT GA | GACCCGCTT C | GGATCAAAAG | AGGAGCTTGT |
| SEQ ID NO:79                 | GACCAGA AGG | GAACGGTA GA | GACGCGCTT T | GGCTCCAAGC | AGGAGCTCGT |
| SEQ ID NO:81                 | AACCAGA AGG | GAACCATC GA | AACGCGCTT T | GGCTCTAAAC | AGGAGCTCAT |
| CLONE A (SEQ ID NO:320)      | TACCAGA AGG | GAACCGTT GA | GACCCGCTT C | GGCTCCAAGG | AAGAGCTCGT |
| Consensus (SEQ ID NO:321)    | -A-CAGA AGG | G-A---T- GA | -AC--G-TT - | GG-TC-AA-- | A-GA-CT--T |

|                              | 351         |            |            |            | 400        |
|------------------------------|-------------|------------|------------|------------|------------|
| SEQ ID NO:83                 | GAACATG ATA | AACACCGC AC | ACTCCTACG G | CATAAAGGTG | ATAGCAGACA |
| SEQ ID NO:85                 | GAACATG ATA | AACACCGC AC | ACTCCTACG G | CATAAAGGTG | ATAGCGGACA |
| SEQ ID NO:75                 | AAACATG ATA | AACACCGC CC | ACGCCTATG G | CATGAAGGTA | ATAGCCGATA |
| SEQ ID NO:77                 | AAACATG ATA | AACACCGC CC | ACGCCTATG G | CATGAAGGTA | ATAGCCGATA |
| SEQ ID NO:73                 | GAACATG ATA | AACACCGC CC | ATGCTACA A | CATGAAGGTC | ATAGCGGACA |
| SEQ ID NO:79                 | GAACATG ATA | AACACCGC CC | ACGCCTACG G | CATCAAGGTC | ATCGCAGACA |
| SEQ ID NO:81                 | CAATATG ATA | AACACGGC CC | ATGCCTACG G | CATAAAGGTC | ATAGCGGACA |
| CLONE A (SEQ ID NO:320)      | CAACATG ATC | TCCACGGC CC | ACCAGTACG G | CATCAAGGTT | ATAGCGGACA |
| Consensus (SEQ ID NO:321)    | -AA-ATGAT- | --CAC-GC -C | A-----A--- | CAT-AAGGT- | AT-GC-GA-A |

|                              | 401         |            |            |            | 450        |
|------------------------------|-------------|------------|------------|------------|------------|
| SEQ ID NO:83                 | TAGTCAT AAA | CCACCGCG CC | GGTGGAGAC C | TTGAGTGGAA | CCCCTTCGTG |
| SEQ ID NO:85                 | TAGTCAT AAA | CCACCGCG CC | GGTGGAGGC C | TCGAGTGGAA | CCCCTTCGTG |
| SEQ ID NO:75                 | TAGTCAT CAA | CCACCGCG CC | GGCGGCGAT C | TGGAGTGGAA | CCCCTTCGTG |
| SEQ ID NO:77                 | TAGTCAT CAA | CCACCGCG CC | GGCGGTGAC C | TGGAGTGGAA | CCCCTTCGTG |
| SEQ ID NO:73                 | TAGTCAT CAA | CCACCGCG CC | GGCGGCGAC C | TGGAGTGGAA | TCCTTTCACC |
| SEQ ID NO:79                 | TAGTAAT CAA | CCACCGCG CC | GGAGGAGAC C | TTGAGTGGAA | CCCCTTCGTC |
| SEQ ID NO:81                 | TCGTCAT AAA | CCACCGCG CA | GGCGGAGAC C | TCGAGTGGAA | CCCGTTCGTT |
| CLONE A (SEQ ID NO:320)      | TAGTGAT AAA | CCACCGCG CA | GGTGGAGAC C | TCGAATGGAA | CCCATACGTC |
| Consensus (SEQ ID NO:321)    | T-GT-AT -AA | CCACCGCG C- | GG-GG-G-- C | T-GA-TGGAA | -CC-T-C--- |

|                              | 451         |            |            |            | 500        |
|------------------------------|-------------|------------|------------|------------|------------|
| SEQ ID NO:83                 | AACGACT ATA | CCTGGACA GA | CTTCTCAAA A | GTCGCCTCCG | GTAAATATAC |
| SEQ ID NO:85                 | AACGACT ATA | CCTGGACA GA | CTTCTCAAA A | GTCGCCTCCG | GTAAATATAC |
| SEQ ID NO:75                 | AACGACT ATA | CCTGGACC GA | CTTCTCGAA G | GTCGCGTCGG | GTAAATACAC |
| SEQ ID NO:77                 | AACGACT ATA | CCTGGACC GA | CTTCTCAAA G | GTCGCGTCGG | GTAAATACAC |
| SEQ ID NO:73                 | AACAGCT ACA | CCTGGACC GA | TTTCTCGAA G | GTCGCGTCGG | GCAAGTACAC |
| SEQ ID NO:79                 | AATGACT ACA | CCTGGACG GA | CTTCTCGAA G | GTCGCTTCCG | GCAAGTACAC |
| SEQ ID NO:81                 | GGGGACT ACA | CCTGGACG GA | CTTCTCAAA G | GTGGCCTCCG | GCAAATATAC |
| CLONE A (SEQ ID NO:320)      | GGCGACT ATA | CCTGGACG GA | CTTTTCTAA G | GTCGCCTCCG | GGAAATACAA |
| Consensus (SEQ ID NO:321)    | -----CT A-A | CCTGGAC- GA | -TT-TC-AA - | GT-GC-TC-G | G-AA-TA-A- |

Figure 14C-2

```
                              501                                                           550
               SEQ ID NO:83   GGCCAAC TAC  CTTGACTT CC  ACCCAAACG A  GCTTCACTGT  TGTGATGAAG
               SEQ ID NO:85   AGCCAAC TAC  CTTGACTT CC  ACCCAAACG A  GCTTCACTGT  TGTGATGAAG
               SEQ ID NO:75   GGCCAAC TAC  CTCGACTT CC  ACCCGAACG A  GCTCCACGCG  GGCGATTCCG
               SEQ ID NO:77   GGCCAAC TAC  CTCGACTT CC  ACCCGAACG A  GCTCCATGCG  GGCGATTCCG
               SEQ ID NO:73   GGCCAAC TAC  CTCGACTT CC  ACCCGAACG A  GCTTCACGCG  GGCGATTCCG
               SEQ ID NO 79   GGCCAAC TAC  CTCGACTT CC  ACCCCAACG A  GGTCAAGTGC  TGCGACGAGG
               SEQ ID NO:81   TGCCAAC TAC  CTCGACTT CC  ACCCCAACG A  GGTCAAGTGC  TGTGACGAGG
      CLONE A (SEQ ID NO:320) GGCCCAC TAC  ATGGACTT CC  ATCCAAACA A  CTACAGCACC  TCAGACGAGG
       Consensus (SEQ ID NO:321) -GCC-ACTAC  -T-GACTT CC  A-CC-AAC- A  ----------  ---GA----G 551                                                           600
               SEQ ID NO:83   GTACCTT TGG  AGGATACC CT  GATATATGT C  ACGACAAAAG  CTGGGACCAG
               SEQ ID NO:85   GTACCTT TGG  AGGATACC CT  GATATATGT C  ACGACAAAAG  CTGGGACCAG
               SEQ ID NO:75   GAACATT TGG  AGGCTATC CC  GACATATGC C  ACGACAAGAG  CTGGGACCAG
               SEQ ID NO:77   GAACATT TGG  AGGCTATC CC  GACATATGC C  ACGACAAGAG  CTGGGACCAG
               SEQ ID NO:73   GAACATT TGG  AGGCTATC CC  GACATATGC C  ACGACAAGAG  CTGGGACCAG
               SEQ ID NO:79   GCACCTT TGG  AGGGTTCC CG  GACATAGCC C  ACGAGAAGAG  CTGGGACCAG
               SEQ ID NO:81   GCACATT TGG  AGGCTTCC CA  GACATAGCC C  ACGAGAAGAG  CTGGGACCAG
      CLONE A (SEQ ID NO:320) GAACCTT CGG  TGGCTTCC CA  GACATTGAT C  ACCTCGTGCC  CTTAACCAG
       Consensus (SEQ ID NO:321) G-AC-TT -GG  -GG-T--C C-  GA-AT---- C  AC--------  CT---ACCAG 601                                                           650
               SEQ ID NO:83   TACTGGC TCT  GGGCGAGC AG  CGAAAGCTA C  GCTGCCTACC  TCAGGAGCAT
               SEQ ID NO:85   TACTGGC TCT  GGGCGAGC AG  CGAAAGCTA C  GCTGCCTACC  TCAGGAGCAT
               SEQ ID NO:75   TACTGGC TCT  GGGCCAGC CA  GGAGAGCTA C  GCGGCCTATC  TCAGGAGCAT
               SEQ ID NO:77   TACTGGC TCT  GGGCCAGC CA  GGAGAGCTA C  GCGGCATATC  TCAGGAGCAT
               SEQ ID NO:73   CACTGGC TCT  GGGCCAGC AA  CGAAAGCTA C  GCCGCCTACC  TCCGGAGCAT
               SEQ ID NO:79   TACTGGC TCT  GGGCGAGC AA  CGAGAGCTA C  GCCGCCTACC  TCAGGAGCAT
               SEQ ID NO:81   CACTGGC TCT  GGGCGAGC GA  TGAGAGCTA C  GCCGCCTACC  TAAGGAGCAT
      CLONE A (SEQ ID NO:320) TACTGGC TGT  GGGCGAGC AA  CGAGAGCTA C  GCCGCCTACC  TCAGGAGCAT
       Consensus (SEQ ID NO:321) -ACTGGC T-T  GGGC-AGC --  -GA-AGCTA C  GC-GC-TA-C  T--GGAGCAT 651                                                           700
               SEQ ID NO:83   AGGGGTT GAC  GCCTGGCG TT  TCGACTACG T  CAAGGGCTAC  GGAGCATGGG
               SEQ ID NO:85   AGGGGTT GAC  GCCTGGTG TT  TCGACTACG T  CAAGGGCTAC  GGAGCCTGGG
               SEQ ID NO:75   CGGCATC GAC  GCCTGGCG CT  TCGACTACG T  CAAGGGCTAT  GCTCCCTGGG
               SEQ ID NO:77   CGGCATC GAT  GCCTGGCG CT  TCGACTACG T  CAAGGGCTAT  GCTCCCTGGG
               SEQ ID NO:73   CGGCATC GAC  GCCTGGCG CT  TCGACTACG T  CAAGGGCTAC  GCTCCCTGGG
               SEQ ID NO:79   CGGCGTT GAC  GCATGGCG CT  TCGACTACG T  CAAGGGCTAC  GGAGCGTGGG
               SEQ ID NO:81   CGGCGTT GAT  GCCTGGCG CT  TTGACTACG T  GAAGGGCTAC  GGAGCGTGGG
      CLONE A (SEQ ID NO:320) AGGGATC GAT  GCGTGGCG CT  TTGACTACG T  TAAGGGCTAC  GGCGCGTGGG
       Consensus (SEQ ID NO:321) -GG--T- GA-  GC-TGG-G -T  T-GACTACG T  -AAGGGCTA-  G---C-TGGG 701                                                           750
               SEQ ID NO:83   TTGTTAA CGA  CTGGCTCA GC  TGGTGGGGA G  GCTGGGCCGT  TGGAGAGTAC
               SEQ ID NO:85   TTGTTAA CGA  CTGGCTCA GC  TGGTGGGGA G  GCTGGGCCGT  TGGAGAGTAC
               SEQ ID NO:75   TCGTCAG GGA  CTGGCTGA AC  TGGTGGGGA G  GCTGGGCAGT  TGGAGAGTAC
               SEQ ID NO:77   TCGTCAA GGA  CTGGCTGA AC  TGGTGGGGA G  GCTGGGCCGT  TGGAGAGTAC
               SEQ ID NO:73   TCGTTAA GAA  CTGGCTGA AC  CGGTGGGGC G  GCTGGGCGGT  TGGAGAGTAC
               SEQ ID NO:79   TCGTCAA GGA  CTGGCTGG AC  TGGTGGGGA G  GCTGGGCCGT  CGGGGAGTAC
               SEQ ID NO:81   TCGTCAA GGA  CTGGCTCA AC  TGGTGGGC G  GCTGGGCCGT  TGGCGAGTAC
      CLONE A (SEQ ID NO:320) TCGTCAA GGA  CTGGCTGA GT  CAGTGGGGC G  GCTGGGCCGT  CGGCGAGTAC
       Consensus (SEQ ID NO:321) T-GT-A- ---A  CTGGCT---- --GTGGGG- G  GCTGGGC-GT  -GG-GAGTAC
```

Figure 14C-3

```
                                      751                                                      800
              SEQ ID NO:83    TGGGACA CGA  ACGTTGAT GC  ACTCCTCAA C  TGGGCATACA  GCAGCGGCGC
              SEQ ID NO:85    TGGGACA CTA  ACGTTGAT GC  ACTCCTCAA C  TGGGCATACA  ACAGCGGCGC
              SEQ ID NO:75    TGGGACA CCA  ACGTCGAC GC  TGTTCTCAA C  TGGGCATACT  CGAGCGGTGC
              SEQ ID NO:77    TGGGACA CCA  ACGTCGAC GC  TGTTCTCAA C  TGGGCATACT  CGAGCGGTGC
              SEQ ID NO:73    TGGGACA CCA  ACGTCGAT GC  ACTCCTGAG C  TGGGCATACT  CGAGCGGTGC
              SEQ ID NO:79    TGGGACA CAA  ACGTTGAT GC  ACTGCTCAA C  TGGGCCTACG  ACAGCGGTGC
              SEQ ID NO:81    TGGGACA CCA  ACGTTGAT GC  ACTCCTCAA C  TGGGCCTACT  CGAGCGATGC
      CLONE A (SEQ ID NO:320) TGGGACA CCA  ACGTCGAT GC  GCTCCTCAA C  TGGGCCTACA  GCAGCGGCGC
      Consensus (SEQ ID NO:321) TGGGACA C-A  ACGT-GA- GC  --T-CT-A- C  TGGGC-TAC-  --AGCG--GC 801                                                      850
              SEQ ID NO:83    CAAGGTC TTT  GACTTCCC GC  TCTACTACA A  GATGGACGAA  GCCTTCGACA
              SEQ ID NO:85    CAAGGTC TTT  GACTTCCC GC  TCTACTACA A  GATGGACGAA  GCCTTCGACA
              SEQ ID NO:75    CAAGGTC TTT  GACTTCGC CC  TCTACTACA A  GATGGACGAG  GCCTTCGATA
              SEQ ID NO:77    CAAGGTC TTT  GACTTCGC CC  TCTACTACA A  GATGGACGAG  GCCTTCGATA
              SEQ ID NO:73    TAAAGTC TTC  GACTTCCC GC  TCTACTACA A  GATGGACGAG  GCCTTCGATA
              SEQ ID NO:79    AAAGTC TTC   GACTTCCC GC  TCTACTACA A  GATGGACGCG  GCCTTTGACA
              SEQ ID NO:81    CAAGGTC TTC  GACTTCCC GC  TCTACTACA A  GATGGATGAG  GCCTTTGACA
      CLONE A (SEQ ID NO:320) CAAGGTC TTC  GACTTCCC GC  TCTACTACA A  GATGGACGAG  GCCTTTGACA
      Consensus (SEQ ID NO:321) -AA-GTC TT-  GACTTC-C -C  TCTACTACA A  GATGGA-G--  GCCTT-GA-A 851                                                      900
              SEQ ID NO:83    ACACCAA CAT  CCCGGCAT TA  GTGGATGCA C  TCAGATACGG  CCAGACAGTG
              SEQ ID NO:85    ATACCAA CAT  CCCCGCTT TG  GTTTACGCC C  TCAAGAATGG  CGGGACAGTG
              SEQ ID NO:75    ACAACAA CAT  TCCCGCCC TG  GTGGACGCC C  TCAGATACGG  CCAGACAGTG
              SEQ ID NO:77    ACAACAA CAT  TCCCGCCC TG  GTGGACGCC C  TCAGATACGG  TCAGACAGTG
              SEQ ID NO:73    ACAACAA CAT  CCCCGCCC TC  GTGGACGCC C  TCAAGAACGG  AGGCACGGTC
              SEQ ID NO:79    ACAAGAA CAT  TCCCGCAC TC  GTCGAGGCC C  TCAAGAACGG  GGGCACAGTC
              SEQ ID NO:81    ACAAAAA CAT  TCCAGCGC TC  GTCTCTGCC C  TTCAGAACGG  CCAGACTGTT
      CLONE A (SEQ ID NO:320) ACAAGAA CAT  TCCCGCCC TC  GTTTACGCC A  TCCAGAACGG  TGAAACCGTC
      Consensus (SEQ ID NO:321) A-A--AA CAT  -CC-GC--T-  GT----GC- -  T-----A-GG  ----AC-GT- 901                                                      950
              SEQ ID NO:83    GTCAGCC GCG  ATCCCTTC AA  GGCGGTAAC T  TTCGTTGCCA  ACCACGATAC
              SEQ ID NO:85    GTCAGCC GCG  ACCCATTC AA  GGCGGTAAC T  TTCGTTGCCA  ACCACGATAC
              SEQ ID NO:75    GTCAGCC GCG  ACCCGTTC AA  GGCTGTGAC G  TTTGTAGCCA  ACCACGATAC
              SEQ ID NO:77    GTCAGCC GCG  ACCCGTTC AA  GGCTGTGAC G  TTTGTAGCCA  ACCACGATAC
              SEQ ID NO:73    GTCAGCC GCG  ACCCGTTC AA  AGCCGTGAC C  TTCGTTGCCA  ACCACGATAC
              SEQ ID NO:79    GTCAGCC GCG  ACCCGTTT AA  GGCCGTAAC C  TTCGTTGCAA  ACCACGACAC
              SEQ ID NO:81    GTCTCCC GCG  ACCCGTTC AA  GGCCGTAAC C  TTTGTAGCAA  ACCACGACAC
      CLONE A (SEQ ID NO:320) GTCAGCA GGG  ATCCCTTC AA  GGCCGTTAC C  TTCGTGGCTA  ACCACGATAC
      Consensus (SEQ ID NO:321) GTC--C- G-G  A-CC-TT- AA  -GC-GT-AC -  TT-GT-GC-A  ACCACGA-AC 951                                                     1000
              SEQ ID NO:83    AGATATA ATC  TGGAACAA GT  ATCCGGCTT A  TGCATTCATC  CTTACCTATG
              SEQ ID NO:85    AGATATA ATC  TGGAACAA GT  ATCCGGCTT A  TGCATTCATC  CTTACCTATG
              SEQ ID NO:75    CGACATA ATC  TGGAACAA GT  ATCCAGCCT A  CGCGTTCATC  CTCACCTACG
              SEQ ID NO:77    CGACATA ATC  TGGAACAA GT  ATCCAGCCT A  CGCGTTCATC  CTCACCTACG
              SEQ ID NO:73    CAACATA ATC  TGGAACAA GT  ATCCGGCCT A  CGCCTTCATC  CTCACCTATG
              SEQ ID NO:79    GGACATA ATT  TGGAACAA GT  ACCCGGCCT A  CGCCTTCATC  CTCACCTACG
              SEQ ID NO:81    CGATATA ATC  TGGAACAA GT  ACCTTGCTT A  TGCTTTCATC  CTCACCTACG
      CLONE A (SEQ ID NO:320) GAACATA ATC  TGGAACAA GT  ACCCTGCCT A  TGCCTTCATC  CTGACCTACG
      Consensus (SEQ ID NO:321) --A-ATA AT-  TGGAACAA GT  A-C--GC-TA  -GC-TTCATC  CT-ACCTA-G
```

Figure 14C-4

```
                              1001                                                    1050
    SEQ ID NO:83   AGGGACA GCC TGTTATAT TC TACCGCGAC T ACGAGGAGTG GCTCAACAAG
    SEQ ID NO:85   AGGGACA GCC TGTTATAT TC TACCGCGAC T ACGAGGAGTG GCTCAACAAG
    SEQ ID NO:75   AGGGCCA GCC GACAATAT TC TACCGCGAC T ACGAGGAGTG GCTCAACAAG
    SEQ ID NO:77   AGGGCCA GCC GACAATAT TC TACCGCGAC T ACGAGGAGTG GCTCAACAAG
    SEQ ID NO:73   AGGGACA GCC GGCAATAT TC TACCGCGAC T ACGAGGAGTG GCTCAACAAG
    SEQ ID NO:79   AGGGCCA GCC GACGATAT TC TACCGCGAC T ACGAGGAGTG GCTCAACAAG
    SEQ ID NO:81   AAGGCCA GCC CGTCATAT TT TACCGCGAC T ACGAGGAGTG GCTCAACAAG
CLONE A (SEQ ID NO:320) AAGGTCA GCC CGTCATCT TC TACCGCGAC T ACGAGGAGTG GCTCAACAAG
Consensus (SEQ ID NO:321) A-GG-CA GCC ----AT-T T- TACCGCGAC T ACGAGGAGTG GCTCAACAAG 1051                                                    1100
    SEQ ID NO:83   GATAAGC TTA ACAACCTC AT CTGGATACA C GATCACCTTG CTGGAGGGAG
    SEQ ID NO:85   GATAAGC TTA ACAACCTC AT CTGGATACA C GATCACCTTG CTGGAGGGAG
    SEQ ID NO:75   GACAAGC TCA AGAACCTC AT CTGGATACA T GACAACCTCG CCGGAGGGAG
    SEQ ID NO:77   GATAAGC TCA AGAACCTC AT CTGGATACA T GACAACCTCG CCGGAGGGAG
    SEQ ID NO:73   GACAGGC TCA GGAACCTC AT CTGGATACA C GACCACCTCG CGGGAGGAAG
    SEQ ID NO:79   GACAGGC TCA AGAACCTC AT CTGGATACA C GACCACCTCG CCGGTGGAAG
    SEQ ID NO:81   GACAGGT TGA ACAACCTC AT ATGGATACA C GACCACCTCG CAGGTGGAAG
CLONE A (SEQ ID NO:320) GACAAAC TCA ACAACCTC AT ATGGATTCA C GAGCACCTGG CAGGGGGAAG
Consensus (SEQ ID NO:321) GA-A---T-A --AACCTC AT -TGGAT-CA - GA--ACCT-G C-GG-GG-AG 1101                                                    1150
    SEQ ID NO:83   TACTGAC ATT GTTTACTA CG ACAGCGACG A GCTTATCTTT GTGAGAAACG
    SEQ ID NO:85   TACTGAC ATT GTTTACTA CG ACAGCGACG A GCTTATCTTT GTGAGAAACG
    SEQ ID NO:75   CACTGAC ATC GTTTACTA CG ACAACGACG A GCTGATATTC GTGAGAAACG
    SEQ ID NO:77   CACTGAC ATC GTTTACTA CG ACAACGACG A GCTGATATTC GTGAGAAACG
    SEQ ID NO:73   CACAGAC ATC ATCTACTA CG ACAGCGACG A GCTTATCTTC GTGAGAAACG
    SEQ ID NO:79   CACCGAC ATA GTCTACTA CG ATAACGATG A ACTCATCTTC GTCAGGAACG
    SEQ ID NO:81   CACGAGC ATA GTTTACTA CG ACAGCGACG A GATGATTTTC GTGAGGAACG
CLONE A (SEQ ID NO:320) CACCAAG ATC CTCTACTA CG ACGACGATG A GCTCATCTTC ATCAGGGAAG
Consensus (SEQ ID NO:321) -AC----AT- -T-TACTA CG A---CGA-GA --T-AT-TT- -T-AG--A-G 1151                                                    1200
    SEQ ID NO 83   GCTATGG CAC CAAACCAG GA CTGATAACC T ATATCAACCT CGGCTCAAGC
    SEQ ID NO:85   GCTATGG CAC CAAACCAG GA CTGATAACC T ATATCAACCT CGGCTCAAGC
    SEQ ID NO:75   GCTACGG AAG CAAGCCGG GA CTGATAACA T ACATCAACCT CGGCTCAAGC
    SEQ ID NO:77   GCTACGG AAG CAAGCCGG GA CTGATAACA T ACATCAACCT CGCCTCAAGC
    SEQ ID NO:73   GCTACGG GGA CAAGCCGG GA CTGATAACC T ACATCAACCT CGGCTCAAGC
    SEQ ID NO:79   GCTACGG GGA CAAGCCGG GG CTTATAACC T ACATCAACCT AGGCTCGAGC
    SEQ ID NO:81   GCTATGG AAG CAAGCCTG GC CTTATAACT T ACATCAACCT CGGCTCGAGC
CLONE A (SEQ ID NO:320) GCTACGG CGA CAGGCCCG GG CTTATAACC T ACATCAACCT CGGTAGCGAC
Consensus (SEQ ID NO:321) GCTA-GG --- CA--CC-GG- CT-ATAAC- T A-ATCAACCT -G------C 1201                                                    1250
    SEQ ID NO:83   AAAGTTG GAA GGTGGGTC TA CGTT...CCA AAGTTCGCCG GTTCATGCAT
    SEQ ID NO:85   AAAGCTG GAA GGTGGGTC TA CGTT...CCA AAGTTCGCCG GTTCATGCAT
    SEQ ID NO:75   AAAGCCG GAA GGTGGGTT TA CGTT...CCG AAGTTCGCAG GCTCGTGCAT
    SEQ ID NO:77   AAAGCCG GAA GGTGGGTT TA CGTT...CCG AAGTTCGCAG GCTCGTGCAT
    SEQ ID NO:73   AAGGCCG GAA GGTGGGTC TA CGTT...CCG AAGTTCGCAG GCTCGTGCAT
    SEQ ID NO:79   AAGGCCG GGA GGTGGGTC TA CGTT...CCG AAGTTCGCGG GAGCGTGCAT
    SEQ ID NO:81   AAGGTTG GAA GGTGGGTT TA TGTG...CCG AAGTTCGCGG GCGCGTGCAT
CLONE A (SEQ ID NO:320) TGGGCGG AGA GATGGGTG AA CGTTGGCTCA AAGTTCGCGG GCTATACAAT
Consensus (SEQ ID NO:321) ---G--G--A G-TGGGT- -A -GT-----C- AAGTTCGC-G G-------AT
```

Figure 14C-5

```
                              1251                                                      1300
              SEQ ID NO:83    CCACGAGTAC  ACCGGCAACC  TCGGCGGTTG  GATAGACAAG  TACGTCTCCT
              SEQ ID NO:85    CCACGAGTAC  ACCGGCAGCC  TCGGCGGTTG  GATAGACAAG  TACGTCTCCT
              SEQ ID NO:75    ACACGAGTAC  ACCGGCAACC  TCGGCGGCTG  GGTGGACAAG  TGGGTGGACT
              SEQ ID NO:77    ACACGAGTAC  ACCGGCAATC  TCGGCGGCTG  GGTGGACAAG  TGGGTGGACT
              SEQ ID NO:73    ACACGAGTAC  ACCGGCAACC  TCGGCGGCTG  GATTGACAAG  TGGGTTGACT
              SEQ ID NO:79    CCACGAGTAC  ACCGGCAACC  TCGGCGGCTG  GGTGGACAAG  TGGGTGGACT
              SEQ ID NO:81    CCACGAGTAT  ACTGGTAACC  TCGGAGGCTG  GGTAGACAAG  TACGTCTACT
     CLONE A (SEQ ID NO:320)  CCACGAATAC  ACCGGAAACC  TCGGCGGCTG  GGTCGACAGG  TACGTCCAGT
     Consensus (SEQ ID NO:321) -CACGA-TA-  AC-GG-A--C  TCGG-GG-TG  G-T-GACA-G  T--GT----T 1301                                                      1350
              SEQ ID NO:83    CCAGCGGCTG  GGTCTATCTT  GAGGCCCCAG  CCCACGACCC  GGCGAACGGC
              SEQ ID NO:85    CCAGCGGCTG  GGTCTACCTT  GAGGCCCCGG  CCCACGACCC  GGCCAATGGC
              SEQ ID NO:75    CAAGCGGCTG  GGTTTACCTC  GAGGCTCCTG  CCCACGACCC  GGCCAACGGC
              SEQ ID NO:77    CAAGCGGCTG  GGTCTACCTC  GAGGCTCCTG  CCCACGACCC  GGCCAACGGC
              SEQ ID NO:73    CAAGCGGTCG  GGTCTACCTT  GAGGCCCCCG  CCCACGACCC  GGCCAACGGC
              SEQ ID NO:79    CAAGCGGGTG  GGTGTACCTC  GAGGCCCCTG  CCCACGACCC  GGCCAACGGC
              SEQ ID NO:81    CAAGCGGCTG  GGTCTATTTC  GAAGCTCCAG  CTTACGACCC  TGCCAACGGG
     CLONE A (SEQ ID NO:320)  ACGACGGCTG  GGTCAAGCTT  ACCGCTCCGC  CACACGATCC  GGCAAACGGC
     Consensus (SEQ ID NO:321) ----CGG--G  GGT--A--T-  ---GC-CC--  C--ACGA-CC  -GC-AA-GG- 1351                                              1393
              SEQ ID NO:83    TACTACGGCT  ACTCCGTATG  GAGCTACTGC  GGGGTTGGGT  GA~
              SEQ ID NO:85    CAGTATGGCT  ACTCCGTCTG  GAGCTATTGC  GGGGTTGGGT  GA~
              SEQ ID NO:75    CAGTACGGCT  ACTCCGTTTG  GAGCTATTGC  GGTGTTGGGT  GA~
              SEQ ID NO:77    CAGTACGGCT  ACTCCGTCTG  GAGCTACTGC  GGTGTTGGGT  GA~
              SEQ ID NO:73    CAGTACGGCT  ACTCCGTATG  GAGCTACTGC  GGTGTTGGGT  GA~
              SEQ ID NO:79    TATTACGGCT  ACTCCGTCTG  GAGCTACTGC  GGGGTGGGCT  GA~
              SEQ ID NO:81    CAGTATGGCT  ACTCCGTGTG  GAGCTATTGC  GGTGTTGGGT  GA~
     CLONE A (SEQ ID NO:320)  TATTACGGCT  ACTCGGTCTG  GAGCTACGCC  GGAGTTGGAT  GA~
     Consensus (SEQ ID NO:321) -A-TA-GGCT  ACTC-GT-TG  GAGCTA---C  GG-GT-GG-T  GA~
```

Figure 14C-6

SEQ ID NO.: 1
atggcaaagtattccgagctcgaagagggcgggctcataatgcaggccttctactgggacgtccccatgggaggaatctggtgggacacgat
agcccagaagatacccgactgggcaagcgccgggatttcggcgatatggattccccggcgagcaagggcatgggcggcgcctattcgatg
ggctacgaccccctacgacttctttgacctcggtgagtacgaccagaagggaacggtagagacgcgctttggctccaagcaggagctcgtgaa
catgataaacaccgcccacgcctatggcatgaaggtaatagccgatatagtcatcaaccaccgcgccggcggtgacctggagtggaacccctt
cgtgaacgactatacctggaccgacttctcaaaggtcgcgtcgggtaaatacacggccaactacctcgacttccacccgaacgagctccatgc
gggcgattccggaacatttggaggctatcccgacatatgccacgacaagagctgggaccagtactggctctgggccagccaggagagctac
gcggcatatctcaggagcatcggcatcgatgcctggcgcttcgactacgtcaaggcctacggagcgtgggtcgtcaaggactggctggactg
gtggggaggctgggccgtcggggagtactgggacacaaacgttgatgcactgctcaactgggcctactcgagcgatgcaaaagtcttcgactt
cccgctctactacaagatggacgcggcctttgacaacaagaacattccgcactcgtcgaggccctcaagaacggggggcacagtcgtcagcc
gcgacccgtttaaggccgtaaccttcgttgcaaaccacgacaccgatataatctggaacaagtatccagcctacgcgttcatcctcacctacgag
ggccagccgacaatattctaccgcgactacgaggagtggctcaacaaggataagctcaagaacctcatctggatacatgacaacctcgccgg
aggaagcactgacatcgtttactacgacaacgacgagctgatattcgtgagaaacggctacggaagcaagccgggactgataacatacatcaa
cctcgcctcaagcaaagccggaaggtgggtttacgttccgaagttcgcaggctcgtgcatacacgagtacaccggcaatctcggcggctgggt
ggacaagtgggtggactcaagcggctgggtctacctcgaggctcctgcccacgacccggccaacggccagtacggctactccgtctggagc
tactgcggtgttgggtga SEQ ID NO.: 2
Met Ala Lys Tyr Ser Glu Leu Glu Glu Gly Gly Leu Ile Met Gln Ala Phe Tyr Trp Asp Val Pro Met
Gly Gly Ile Trp Trp Asp Thr Ile Ala Gln Lys Ile Pro Asp Trp Ala Ser Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Met Lys Val Ile Ala Asp Ile Val Ile Asn His Arg Ala Gly Gly
Asp Leu Glu Trp Asn Pro Phe Val Asn Asp Tyr Thr Trp Thr Asp Phe Ser Lys Val Ala Ser Gly Lys
Tyr Thr Ala Asn Tyr Leu Asp Phe His Pro Asn Glu Leu His Ala Gly Asp Ser Gly Thr Phe Gly Gly
Tyr Pro Asp Ile Cys His Asp Lys Ser Trp Asp Gln Tyr Trp Leu Trp Ala Ser Gln Glu Ser Tyr Ala
Ala Tyr Leu Arg Ser Ile Gly Ile Asp Ala Trp Arg Phe Asp Tyr Val Lys Gly Tyr Gly Ala Trp Val
Val Lys Asp Trp Leu Asp Trp Trp Gly Gly Trp Ala Val Gly Glu Tyr Trp Asp Thr Asn Val Asp Ala
Leu Leu Asn Trp Ala Tyr Ser Ser Asp Ala Lys Val Phe Asp Phe Pro Leu Tyr Tyr Lys Met Asp Ala
Ala Phe Asp Asn Lys Asn Ile Pro Ala Leu Val Glu Ala Leu Lys Asn Gly Gly Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Lys Leu Lys Asn Leu Ile Trp Ile His Asp Asn Leu Ala Gly Gly Ser Thr Asp Ile Val Tyr
Tyr Asp Asn Asp Glu Leu Ile Phe Val Arg Asn Gly Tyr Gly Ser Lys Pro Gly Leu Ile Thr Tyr Ile
Asn Leu Ala Ser Ser Lys Ala Gly Arg Trp Val Tyr Val Pro Lys Phe Ala Gly Ser Cys Ile His Glu
Tyr Thr Gly Asn Leu Gly Gly Trp Val Asp Lys Trp Val Asp Ser Ser Gly Trp Val Tyr Leu Glu Ala
Pro Ala His Asp Pro Ala Asn Gly Gln Tyr Gly Tyr Ser Val Trp Ser Tyr Cys Gly Val Gly SEQ ID NO.: 3
atggccaagtacctggagctcgaagagggcgggctcataatgcaggccttctactgggacgtccccatgggaggaatctggtgggacacgat
agcccagaagatacccgactgggcaagcgccgggatttcggcgatatggattccccggcgagcaagggcatgggcggcgcctattcgatg
ggctacgaccccctacgacttctttgacctcggtgagtacgaccagaagggaacggtagagacgcgctttggctccaagcaggagctcgtgaa
catgataaacaccgcccacgcctacggcatcaaggtcatcgcagacatagtaatcaaccaccgcgccggaggagaccttgagtggaacccct
tcgtcaatgactacacctggacggacttctcgaaggtcgcttccggcaagtacacggccaattacctcgacttccacccgaacgagctccatgc
gggcgattccggaacatttggaggctatcccgacatatgccacgacaagagctgggaccagtactggctctgggccagccaggagagctac
gcggcatatctcaggagcatcggcatcgatgcctggcgcttcgactacgtcaaggcctatgtccctgggtcgtcaaggactggctgaactggt
ggggaggctgggccggttggagagtactgggacaccaacgtcgacgctgttctcaactgggcatactcgagcggtgccaaggtctttgacttcg
ccctctactacaagatggatgaggcctttgacaacaaaaacattccagcgctcgtctctgcccttcagaacggccagactgttgtctcccgcgac
ccgttcaaggccgtaaccttgtagcaaaccacgacaccgatataatctggaacaagtatccagcctacgcgttcatcctcacctacgagggcc rgccgacaatattctaccgcgactacgaggagtggctcaacaaggataagctcaagaacctcatctggatacatgacaacctcgccggagga
agcactgacatcgtttactacgacaacgacgagctgatattcgtgagaaacggctacggaagcaagccgggactgataacatacatcaacctc
gcctcaagcgaagccggaaggtgggtctacgttccgaagttcgcgggagcgtgcatccacgagtacaccggcaacctcggcggctgggtgg
acaagtgggtggactcaagcgggtgggtgtacctcgaggcccctgcccacgacccggccaacggctattacggctactccgtctggagctatt
gcggtgttgggtga SEQ ID NO.: 4
Met Ala Lys Tyr Leu Glu Leu Glu Glu Gly Gly Leu Ile Met Gln Ala Phe Tyr Trp Asp Val Pro Met
Gly Gly Ile Trp Trp Asp Thr Ile Ala Gln Lys Ile Pro Asp Trp Ala Ser Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly Gly
Asp Leu Glu Trp Asn Pro Phe Val Asn Asp Tyr Thr Trp Thr Asp Phe Ser Lys Val Ala Ser Gly Lys
Tyr Thr Ala Asn Tyr Leu Asp Phe His Pro Asn Glu Leu His Ala Gly Asp Ser Gly Thr Phe Gly Gly
Tyr Pro Asp Ile Cys His Asp Lys Ser Trp Asp Gln Tyr Trp Leu Trp Ala Ser Gln Glu Ser Tyr Ala
Ala Tyr Leu Arg Ser Ile Gly Ile Asp Ala Trp Arg Phe Asp Tyr Val Lys Gly Tyr Ala Pro Trp Val
Val Lys Asp Trp Leu Asn Trp Trp Gly Gly Trp Ala Val Gly Glu Tyr Trp Asp Thr Asn Val Asp Ala
Val Leu Asn Trp Ala Tyr Ser Ser Gly Ala Lys Val Phe Asp Phe Ala Leu Tyr Tyr Lys Met Asp Glu
Ala Phe Asp Asn Lys Asn Ile Pro Ala Leu Val Ser Ala Leu Gln Asn Gly Gln Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Lys Leu Lys Asn Leu Ile Trp Ile His Asp Asn Leu Ala Gly Gly Ser Thr Asp Ile Val Tyr
Tyr Asp Asn Asp Glu Leu Ile Phe Val Arg Asn Gly Tyr Gly Ser Lys Pro Gly Leu Ile Thr Tyr Ile
Asn Leu Ala Ser Ser Glu Ala Gly Arg Trp Val Tyr Val Pro Lys Phe Ala Gly Ala Cys Ile His Glu
Tyr Thr Gly Asn Leu Gly Gly Trp Val Asp Lys Trp Val Asp Ser Ser Gly Trp Val Tyr Leu Glu Ala
Pro Ala His Asp Pro Ala Asn Gly Tyr Tyr Gly Tyr Ser Val Trp Ser Tyr Cys Gly Val Gly SEQ ID NO.: 5
atggccaagtactccgagctggaagagggcggcgttataatgcaggccttctactgggacgtcccaggtggaggaatctggtgggacaccat
caggagcaagataccggagtggtacgaggcgggaatatccgccatttggattccccggcaagcaagggcatgggcggcgcctattcgatg
ggctacgaccctacgacttctttgacctcggtgagtacgaccagaagggaacggtagagacgcgctttggctccaagcaggagctcgtgaa
catgataaacaccgcccacgcctatggcatgaaggtaatagccgatatagtcatcaaccaccgcgccggcggtgacctggagtggaacccctt
cgtgaacgactatacctggaccgacttctcaaaggtcgcgtcgggtaaatacacggccaactacctcgacttccacccgaacgagctccatgc
gggcgattccggaacatttggaggctatcccgacatatgccacgacaagagctgggaccagtactggctctgggccagccaggagagctac
gcggcatatctcaggagcatcggcatcgatgcctggcgcttcgactacgtcaagggctatgctccctgggtcgtcaaggactggctgaactggt
ggggaggctggccggttggagagtactgggacaccaacgtcgacgctgttctcaactgggcatactcgagcggtgccaaggtctttgacttcg
ccctctactacaagatggatgaggcctttgacaacaaaaacattccagcgctcgtctctgcccttcagaacggccagactgttgtctcccgcgac
ccgttcaaggccgtaacctttgtagcaaaccacgacaccgatataatctggaacaagtaccttgcttatgctttcatcctcacctacgaaggccag
cccgtcatattctaccgcgaccacgaggagtggctcaacaaggacaggttgaacaacctcatatggatacacgaccacctcgcaggtggaag
caccgacatagtctactacgataacgatgaactcatcttcgtcaggaacggctacggggacaagccggggcttataacctacatcaacctaggc
tcgagcaaggccggaaggtgggtttatgtgccgaagttcgcgggcgcgtgcatccacgagtatactggtaacctcggaggctgggtagacaa
gtacgtctactcaagcggctgggtctatctcgaagctccagcttacgaccctgccaacgggcagtatggctactccgtgtggagctactgcggg
gtgggctga SEQ ID NO.: 6
Met Ala Lys Tyr Ser Glu Leu Glu Glu Gly Gly Val Ile Met Gln Ala Phe Tyr Trp Asp Val Pro Gly
Gly Gly Ile Trp Trp Asp Thr Ile Arg Ser Lys Ile Pro Glu Trp Tyr Glu Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Met Lys Val Ile Ala Asp Ile Val Ile Asn His Arg Ala Gly Gly Asp Leu Glu Trp Asn Pro Phe Val Asn Asp Tyr Thr Trp Thr Asp Phe Ser Lys Val Ala Ser Gly Lys
Tyr Thr Ala Asn Tyr Leu Asp Phe His Pro Asn Glu Leu His Ala Gly Asp Ser Gly Thr Phe Gly Gly
Tyr Pro Asp Ile Cys His Asp Lys Ser Trp Asp Gln Tyr Trp Leu Trp Ala Ser Gln Glu Ser Tyr Ala
Ala Tyr Leu Arg Ser Ile Gly Ile Asp Ala Trp Arg Phe Asp Tyr Val Lys Gly Tyr Ala Pro Trp Val
Val Lys Asp Trp Leu Asn Trp Trp Gly Gly Trp Ala Val Gly Glu Tyr Trp Asp Thr Asn Val Asp Ala
Val Leu Asn Trp Ala Tyr Ser Ser Gly Ala Lys Val Phe Asp Phe Ala Leu Tyr Tyr Lys Met Asp Glu
Ala Phe Asp Asn Lys Asn Ile Pro Ala Leu Val Ser Ala Leu Gln Asn Gly Gln Thr Val Val Ser Arg
Asp Pro Phe Lys Ala Val Thr Phe Val Ala Asn His Asp Thr Asp Ile Ile Trp Asn Lys Tyr Leu Ala
Tyr Ala Phe Ile Leu Thr Tyr Glu Gly Gln Pro Val Ile Phe Tyr Arg Asp His Glu Glu Trp Leu Asn
Lys Asp Arg Leu Asn Asn Leu Ile Trp Ile His Asp His Leu Ala Gly Gly Ser Thr Asp Ile Val Tyr
Tyr Asp Asn Asp Glu Leu Ile Phe Val Arg Asn Gly Tyr Gly Asp Lys Pro Gly Leu Ile Thr Tyr Ile
Asn Leu Gly Ser Ser Lys Ala Gly Arg Trp Val Tyr Val Pro Lys Phe Ala Gly Ala Cys Ile His Glu
Tyr Thr Gly Asn Leu Gly Gly Trp Val Asp Lys Tyr Val Tyr Ser Ser Gly Trp Val Tyr Leu Glu Ala
Pro Ala Tyr Asp Pro Ala Asn Gly Gln Tyr Gly Tyr Ser Val Trp Ser Tyr Cys Gly Val Gly SEQ ID NO.: 9
atggccaagtactccgagctggaagagggcgggctcataatgcaggccttctactgggacgtccccatgggaggaatctggtgggacacgat
agcccagaagatacccgactgggcaagcgccgggatttcggcgatatggattccccggcgagcaagggcatgggcggcgcctattcgatg
ggctacgacccctacgacttctttgacctcggtgagtacgaccagaagggaacggtagagacgcgctttggctccaagcaggagctcgtgaa
catgataaacacggcccatgcctacggcataaaggtcatagcggacatcgtcataaaccaccgcgcaggcggagacctcgagtggaacccg
ttcgttggggactacacctggacggacttctcaaaggtggcctcgggcaaatatactgccaactacctcgacttccacccgaacgagctccatg
cgggcgattccggaacatttggaggctatcccgacatatgccacgacaagagctgggaccagtactggctctgggccagccaggagagctac
gcggcatatctcaggagcatcggcatcgatgcctggcgcttcgactacgtcaagggctatgctccctgggtcgtcaaggactggctgaactggt
ggggaggctgggcggttggagagtactgggacaccaacgtcgacgctgttctcaactggcatactcgagcggtgccaaggtctttgacttcg
ccctctactacaagatggacgaggccttcgataacaacaacattcccgccctggtggacgccctcagatacggtcagacagtggtcagccgcg
acccgttcaaggctgtgacgtttgtagccaaccacgataccgatataatctggaacaagtatccagcctacgcgttcatcctcacctacgagggc
cagccgacaatattctaccgcgactacgaggagtggctcaacaaggataagctcaagaacctcatctggatacatgacaacctcgccggagg
aagcactgacatcgtttactacgacaacgacgagctgatattcgcgagaaacggctacggaagcaagccgggactgataacatacatcaacct
cgcctcaagcaaagccggaaggtgggtttacgttccgaagttcgcaggctcgtgcatacacgagtacaccggcaatctcggcggctgggtgg
acaagtgggtggactcaagcggctgggtctacctcgaggctcctgcccacgacccggccaacggccagtacggctactccgtctggagctac
tgcggtgttgggtga SEQ ID NO.: 10
Met Ala Lys Tyr Ser Glu Leu Glu Glu Gly Gly Leu Ile Met Gln Ala Phe Tyr Trp Asp Val Pro Met
Gly Gly Ile Trp Trp Asp Thr Ile Ala Gln Lys Ile Pro Asp Trp Ala Ser Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly Gly
Asp Leu Glu Trp Asn Pro Phe Val Gly Asp Tyr Thr Trp Thr Asp Phe Ser Lys Val Ala Ser Gly Lys
Tyr Thr Ala Asn Tyr Leu Asp Phe His Pro Asn Glu Leu His Ala Gly Asp Ser Gly Thr Phe Gly Gly
Tyr Pro Asp Ile Cys His Asp Lys Ser Trp Asp Gln Tyr Trp Leu Trp Ala Ser Gln Glu Ser Tyr Ala
Ala Tyr Leu Arg Ser Ile Gly Ile Asp Ala Trp Arg Phe Asp Tyr Val Lys Gly Tyr Ala Pro Trp Val
Val Lys Asp Trp Leu Asn Trp Trp Gly Gly Trp Ala Val Gly Glu Tyr Trp Asp Thr Asn Val Asp Ala
Val Leu Asn Trp Ala Tyr Ser Ser Gly Ala Lys Val Phe Asp Phe Ala Leu Tyr Tyr Lys Met Asp Glu
Ala Phe Asp Asn Asn Asn Ile Pro Ala Leu Val Asp Ala Leu Arg Tyr Gly Gln Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Lys Leu Lys Asn Leu Ile Trp Ile His Asp Asn Leu Ala Gly Gly Ser Thr Asp Ile Val Tyr
Tyr Asp Asn Asp Glu Leu Ile Phe Ala Arg Asn Gly Tyr Gly Ser Lys Pro Gly Leu Ile Thr Tyr Ile
Asn Leu Ala Ser Ser Lys Ala Gly Arg Trp Val Tyr Val Pro Lys Phe Ala Gly Ser Cys Ile His Glu

Figure 16C

Tyr Thr Gly Asn Leu Gly Gly Trp Val Asp Lys Trp Val Asp Ser Ser Gly Trp Val Tyr Leu Glu Ala
Pro Ala His Asp Pro Ala Asn Gly Gln Tyr Gly Tyr Ser Val Trp Ser Tyr Cys Gly Val Gly

SEQ ID NO.: 11
atggccaagtacctggagctcgaggagggcgggctcataatgcaggccttctactgggacgtccccatgggaggaatctggtgggacacgat
agcccagaagatacccgactgggcaagcgccgggatttcggcgatatggattccccggcgagcaagggcatgggcggcgcctattcgatg
ggctacgaccccctacgacttctttgacctcggtgagtacgaccagaagggaacggtagagacgcgctttggctccaagcaggagctcgtgaa
catgataaacaccgcccacgcctatggcatgaaggtaatagccgatatagtcatcaaccaccgcgccggcggtgacctggagtggaaccccit
cgtgaacgactatacctggaccgacttctcaaaggtcgcgtcgggtaaatacacggccaactacctcgacttccaccccgaacgagctccatgc
gggcgattccggaacatttggaggctatcccgacatatgccacgacaagagctgggaccagtactggctctgggccagcaggagagctac
gcggcatatctcaggagcatcggcatcgatgcctggcgcttcgactacgtcaagggctatgctccctgggtcgtcaaggactggctgaactggt
ggggaggctggcggttggagagtactgggacaccaacgtcgacgctgttctcaactgggcatactcgagcggtgccaaggtctttgacttcg
ccctctactacaagatggacgaggccttcgataacaacaacattcccgccctggtggacgccctcagatacggtcagacagtggtcagccgcg
acccgttcaaggctgtgacgtttgtagccaaccacgataccgatataatctggaacaagtatccagcctacgcgttcatcctcacctacgagggc
cagccgacaatattctaccgcgactacgaggagtggctcaacaaggatacgctcaagaacctcatctggatacatgacaacctcgccggagg
aagcacgagcatagtttactacgacagcgacgagatgatcttcgtgaggaacggctatggaagcaagcctggccttataacttacatcaacctc
ggctcgagcaaggttggaaggtgggtctacgttccgaagttcgcgggagcgtgcatccacgagtacaccggcaacctcggcggctgggtgg
acaagtgggtggactcaagcgggtgggtgtacctcgaggcccctgcccacgacccggccaacggctattacggctactccgtctggagctac
tgcggtgttggctga SEQ ID NO.: 12
Met Ala Lys Tyr Leu Glu Leu Glu Glu Gly Gly Leu Ile Met Gln Ala Phe Tyr Trp Asp Val Pro Met
Gly Gly Ile Trp Trp Asp Thr Ile Ala Gln Lys Ile Pro Asp Trp Ala Ser Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Met Lys Val Ile Ala Asp Ile Val Ile Asn His Arg Ala Gly Gly
Asp Leu Glu Trp Asn Pro Phe Val Asn Asp Tyr Thr Trp Thr Asp Phe Ser Lys Val Ala Ser Gly Lys
Tyr Thr Ala Asn Tyr Leu Asp Phe His Pro Asn Glu Leu His Ala Gly Asp Ser Gly Thr Phe Gly Gly
Tyr Pro Asp Ile Cys His Asp Lys Ser Trp Asp Gln Tyr Trp Leu Trp Ala Ser Gln Glu Ser Tyr Ala
Ala Tyr Leu Arg Ser Ile Gly Ile Asp Ala Trp Arg Phe Asp Tyr Val Lys Gly Tyr Ala Pro Trp Val
Val Lys Asp Trp Leu Asn Trp Trp Gly Gly Trp Ala Val Gly Glu Tyr Trp Asp Thr Asn Val Asp Ala
Val Leu Asn Trp Ala Tyr Ser Ser Gly Ala Lys Val Phe Asp Phe Ala Leu Tyr Tyr Lys Met Asp Glu
Ala Phe Asp Asn Asn Asn Ile Pro Ala Leu Val Asp Ala Leu Arg Tyr Gly Gln Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Thr Leu Lys Asn Leu Ile Trp Ile His Asp Asn Leu Ala Gly Gly Ser Thr Ser Ile Val Tyr
Tyr Asp Ser Asp Glu Met Ile Phe Val Arg Asn Gly Tyr Gly Ser Lys Pro Gly Leu Ile Thr Tyr Ile
Asn Leu Gly Ser Ser Lys Val Gly Arg Trp Val Tyr Val Pro Lys Phe Ala Gly Ala Cys Ile His Glu
Tyr Thr Gly Asn Leu Gly Gly Trp Val Asp Lys Trp Val Asp Ser Ser Gly Trp Val Tyr Leu Glu Ala
Pro Ala His Asp Pro Ala Asn Gly Tyr Tyr Gly Tyr Ser Val Trp Ser Tyr Cys Gly Val Gly SEQ ID NO.: 13
atggccaagtacctggagctcgaagagggcggggtcataatgcaggcgttctactgggacgtgccttcaggaggaatatggtgggacacaat
acggcagaagataccggagtggtacgatgccggaatctccgcaatatggattccccggcgagcaagggcatgggcggcgcctattcgatg
ggctacgaccccctacgacttctttgacctcggtgagtatgaccagaagggaacggtagagacgcgctttggctccaagcaggagctcgtgaac
atgataaacacggcacatgcctacggcataaaggtcatagcggacatcgtcataaaccaccgcgcaggcggagacctcgagtggaacccgtt
cgttggggactacacctggacggacttctcaaaggtggcctcgggcaaatatactgccaactacctcgacttccaccccaacgaggtcaagtg
ctgtgacgagggcacatttggaggcttcccagacatagcccacgagaagagctgggaccagcactggctctgggcgagcgatgagagctac
gccgcctaccaaggagcatcggcgttgatgcctggcgcttcgactacgtcaagggctacggagcgtgggtcgtcaaggactggctggactg
gtggggaggctgggccgtcggggagtactgggacacaaacgttgatgcactgctcaactgggcctactcgagcgatgcaaaagtcttcgactt cccgctctactacaagatggatgaggcctttgacaacaaaaacattccagcgctcgtctctgccctcagaacggccagactgttgtctcccgcg
acccgttcaaggccgtaacctttgtagcaaaccacgacaccgatataatctggaacaagtatccagcctacgcgttcatcctcacctacgaggg
ccagccgacaatattctaccgcgactacgaggagtggctcaacaaggataagctcaagaacctcatctggatacatgacaacctcgccggag
gaagcactgacatagtctactacgataacgatgaactcatcttcgtcaggaacggctacggggacaagccggggcttataacctacatcaacct
aggctcgagcaaggccggaaggtgggtttatgtgccgaagttcgcgggcgcgtgcatccacgagtatactggtaacctcggaggctgggtag
acaagtacgtctactcaagcggctgggtctatctcgaagctccagcttacgaccctgccaacgggcagtatggctactccgtgtggagctactg
cggtgttggctga SEQ ID NO.: 14
Met Ala Lys Tyr Leu Glu Leu Glu Glu Gly Gly Val Ile Met Gln Ala Phe Tyr Trp Asp Val Pro Ser
Gly Gly Ile Trp Trp Asp Thr Ile Arg Gln Lys Ile Pro Glu Trp Tyr Asp Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly Gly
Asp Leu Glu Trp Asn Pro Phe Val Gly Asp Tyr Thr Trp Thr Asp Phe Ser Lys Val Ala Ser Gly Lys
Tyr Thr Ala Asn Tyr Leu Asp Phe His Pro Asn Glu Val Lys Cys Cys Asp Glu Gly Thr Phe Gly
Gly Phe Pro Asp Ile Ala His Glu Lys Ser Trp Asp Gln His Trp Leu Trp Ala Ser Asp Glu Ser Tyr
Ala Ala Tyr Leu Arg Ser Ile Gly Val Asp Ala Trp Arg Phe Asp Tyr Val Lys Gly Tyr Gly Ala Trp
Val Val Lys Asp Trp Leu Asp Trp Trp Gly Gly Trp Ala Val Gly Glu Tyr Trp Asp Thr Asn Val Asp
Ala Leu Leu Asn Trp Ala Tyr Ser Ser Asp Ala Lys Val Phe Asp Phe Pro Leu Tyr Tyr Lys Met Asp
Glu Ala Phe Asp Asn Lys Asn Ile Pro Ala Leu Val Ser Ala Leu Gln Asn Gly Gln Thr Val Val Ser
Arg Asp Pro Phe Lys Ala Val Thr Phe Val Ala Asn His Asp Thr Asp Ile Ile Trp Asn Lys Tyr Pro
Ala Tyr Ala Phe Ile Leu Thr Tyr Glu Gly Gln Pro Thr Ile Phe Tyr Arg Asp Tyr Glu Glu Trp Leu
Asn Lys Asp Lys Leu Lys Asn Leu Ile Trp Ile His Asp Asn Leu Ala Gly Gly Ser Thr Asp Ile Val
Tyr Tyr Asp Asn Asp Glu Leu Ile Phe Val Arg Asn Gly Tyr Gly Asp Lys Pro Gly Leu Ile Thr Tyr
Ile Asn Leu Gly Ser Ser Lys Ala Gly Arg Trp Val Tyr Val Pro Lys Phe Ala Gly Ala Cys Ile His
Glu Tyr Thr Gly Asn Leu Gly Gly Trp Val Asp Lys Tyr Val Tyr Ser Ser Gly Trp Val Tyr Leu Glu
Ala Pro Ala Tyr Asp Pro Ala Asn Gly Gln Tyr Gly Tyr Ser Val Trp Ser Tyr Cys Gly Val Gly SEQ ID NO.: 15
atggccaagtactccgagctggaagagggcgggctcataatgcaggccttctactgggacgtccccatgggaggaatctggtgggacacgat
agcccagaagatacccgactgggcaagcgccgggatttcggcgatatggattcccccggcgagcaagggcatgggcggcgcctattcgatg
ggctacgaccccctacgacttctttgacctcggtgagtacgaccagaagggaacggtagagacgcgctttggctccaagcaggagctcgtgaa
catgataaacacggcccatgcctacggcataaaggtcatagcggacatcgtcataaaccaccgcgcaggcggagacctcgagtggaacccg
ttcgttggggactacacctggacggacttctcaaaggtggcctcgggcaaatatactgccaactacctcgacttccacccgaacgagctccatg
cgggcgattccggaacatttggaggctatcccgacatatgccacgacaagagctgggaccagtactggctctgggccagccaggagagctac
gcggcatatctcaggagcatcggcatcgatgcctggcgcttcgactacgtcaagggctacggagcgtgggtcgtcaaggactggctggactg
gtggggaggctgggccgtcggggagtactgggacacaaacgttgatgcactgctcaactgggcctactcgagcgatgcaaaagtcttcgactt
cccgctctactacaagatggatgaggcctttgacaacaaaaacattccagcgctcgtctctgcccttcagaacggccagactgttgtctcccgcg
acccgttcaaggccgtaacctttgtagcaaaccacgacaccgatataatttggaacaagtacccggcctacgccttcatcctcacctacgaggg
ccagccgacatattctaccgcgactacgaggagtggctcaacaaggacaggctcaagaacctcatctggatacacgaccaccttgccggtg
gaagcactgacatcgtttactacgacaacgacgagctgatattcgtgagaaacggctacggaagcaagccgggactgataacatacatcaacc
tcgcctcaagcaaagccggaaggtgggtttatgtgccgaagttcgcgggcgcgtgcatccacgagtatactggtaacctcggaggctgggtag
acaagtacgtctactcaagcggctgggtctatctcgaagctccagcttacgaccctgccaacgggcagtatggctactccgtgtggagctattgc
ggtgttgggtga SEQ ID NO.: 16
Met Ala Lys Tyr Ser Glu Leu Glu Glu Gly Gly Leu Ile Met Gln Ala Phe Tyr Trp Asp Val Pro Met
Gly Gly Ile Trp Trp Asp Thr Ile Ala Gln Lys Ile Pro Asp Trp Ala Ser Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp

Figure 16E

Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly Gly
Asp Leu Glu Trp Asn Pro Phe Val Gly Asp Tyr Thr Trp Thr Asp Phe Ser Lys Val Ala Ser Gly Lys
Tyr Thr Ala Asn Tyr Leu Asp Phe His Pro Asn Glu Leu His Ala Gly Asp Ser Gly Thr Phe Gly Gly
Tyr Pro Asp Ile Cys His Asp Lys Ser Trp Asp Gln Tyr Trp Leu Trp Ala Ser Gln Glu Ser Tyr Ala
Ala Tyr Leu Arg Ser Ile Gly Ile Asp Ala Trp Arg Phe Asp Tyr Val Lys Gly Tyr Gly Ala Trp Val
Val Lys Asp Trp Leu Asp Trp Trp Gly Gly Trp Ala Val Gly Glu Tyr Trp Asp Thr Asn Val Asp Ala
Leu Leu Asn Trp Ala Tyr Ser Ser Asp Ala Lys Val Phe Asp Phe Pro Leu Tyr Tyr Lys Met Asp Glu
Ala Phe Asp Asn Lys Asn Ile Pro Ala Leu Val Ser Ala Leu Gln Asn Gly Gln Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Arg Leu Lys Asn Leu Ile Trp Ile His Asp His Leu Ala Gly Gly Ser Thr Asp Ile Val Tyr
Tyr Asp Asn Asp Glu Leu Ile Phe Val Arg Asn Gly Tyr Gly Ser Lys Pro Gly Leu Ile Thr Tyr Ile
Asn Leu Ala Ser Ser Lys Ala Gly Arg Trp Val Tyr Val Pro Lys Phe Ala Gly Ala Cys Ile His Glu
Tyr Thr Gly Asn Leu Gly Gly Trp Val Asp Lys Tyr Val Tyr Ser Ser Gly Trp Val Tyr Leu Glu Ala
Pro Ala Tyr Asp Pro Ala Asn Gly Gln Tyr Gly Tyr Ser Val Trp Ser Tyr Cys Gly Val Gly

SEQ ID NO.: 17
atggccaagtactccgagctggaaggggggcgggctcataatgcaggccttctactgggacgtccccatgggaggaatctggtgggacacgat
agcccagaagatacccgactgggcaagcgccgggatttcggcgatatggattccccggcgagcaagggcatgggcggcgcctattcgatg
ggctacgaccccgtacgacttctttgacctcggtgagtacgaccaggagggaacggtagagacgcgctttggctccaagcaggagctcgtgaa
catgataaacacggcccatgcctacggcataaaggtcatagcggacatcgtcataaaccaccgcgcaggcggagacctcgagtggaacccg
ttcgttggggactacacctggacggacttctcaaaggtggcctcgggcaaatatactgccaactacctcgacttccaccccaacgaggtcaagt
gctgtgacgagggcacatttggaggcttcccagacatagcccacgagaagagctgggaccagcactggctctgggcgagcgatgagagcta
cgccgcctacctaaggagcatcggcgttgatgcctggcgcttcgactacgtcaagggctacggagcgtgggtcgtcaaggactggctggact
ggtggggaggctgggccgtcggggagtactgggacacaaacgttgatgcactgctcaactgggcctactcgagcgatgcaaaagtcttcgac
ttcccgctctactacaagatggacgcggccttgacaacaagaacattcccgcactcgtcgaggccctcaagaacgggggcacagtcgtcagc
cgcgacccgtttaaggccgtaaccttcgttgcaaaccacgacaccgatataatctggaacaagtatccagcctacgcgttcatcctcacctacga
gggccagccgacaatattctaccgcgactacgaggagtggctcaacaaggataagctcaagaacctcatctggatacatgacaacctcgccg
gaggaagcacgagcatagtttactacgacagcgacgagatgatcttcgtgaggaacggctatggaagcaagcctggccttataacttacatcaa
cctcggctcgagcaaggttggaaggtgggtttacgttccgaagttcgcaggctcgtgcatacacgagtacaccggcaatctcggcggctgggt
ggacaagtgggtggactcaagcggctgggtctacctcgaggctcctgcccacgacccggccaacggccagtacggctactccgtctggagc
tactgcggtgttgggtga SEQ ID NO.: 18
Met Ala Lys Tyr Ser Glu Leu Glu Gly Gly Gly Leu Ile Met Gln Ala Phe Tyr Trp Asp Val Pro Met
Gly Gly Ile Trp Trp Asp Thr Ile Ala Gln Lys Ile Pro Asp Trp Ala Ser Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Glu Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly Gly
Asp Leu Glu Trp Asn Pro Phe Val Gly Asp Tyr Thr Trp Thr Asp Phe Ser Lys Val Ala Ser Gly Lys
Tyr Thr Ala Asn Tyr Leu Asp Phe His Pro Asn Glu Val Lys Cys Cys Asp Glu Gly Thr Phe Gly
Gly Phe Pro Asp Ile Ala His Glu Lys Ser Trp Asp Gln His Trp Leu Trp Ala Ser Asp Glu Ser Tyr
Ala Ala Tyr Leu Arg Ser Ile Gly Val Asp Ala Trp Arg Phe Asp Tyr Val Lys Gly Tyr Gly Ala Trp
Val Val Lys Asp Trp Leu Asp Trp Trp Gly Gly Trp Ala Val Gly Glu Tyr Trp Asp Thr Asn Val Asp
Ala Leu Leu Asn Trp Ala Tyr Ser Ser Asp Ala Lys Val Phe Asp Phe Pro Leu Tyr Tyr Lys Met Asp
Ala Ala Phe Asp Asn Lys Asn Ile Pro Ala Leu Val Glu Ala Leu Lys Asn Gly Gly Thr Val Val Ser
Arg Asp Pro Phe Lys Ala Val Thr Phe Val Ala Asn His Asp Thr Asp Ile Ile Trp Asn Lys Tyr Pro
Ala Tyr Ala Phe Ile Leu Thr Tyr Glu Gly Gln Pro Thr Ile Phe Tyr Arg Asp Tyr Glu Glu Trp Leu
Asn Lys Asp Lys Leu Lys Asn Leu Ile Trp Ile His Asp Asn Leu Ala Gly Gly Ser Thr Ser Ile Val

Figure 16F

Tyr Tyr Asp Ser Asp Glu Met Ile Phe Val Arg Asn Gly Tyr Gly Ser Lys Pro Gly Leu Ile Thr Tyr
Ile Asn Leu Gly Ser Ser Lys Val Gly Arg Trp Val Tyr Val Pro Lys Phe Ala Gly Ser Cys Ile His
Glu Tyr Thr Gly Asn Leu Gly Gly Trp Val Asp Lys Trp Val Asp Ser Ser Gly Trp Val Tyr Leu Glu
Ala Pro Ala His Asp Pro Ala Asn Gly Gln Tyr Gly Tyr Ser Val Trp Ser Tyr Cys Gly Val Gly

SEQ ID NO.: 19
atggccaagtacctggagctcgaagagggcgggctcataatgcaggccttctactgggacgtccccatggggaggaatctggtgggacacgat
agcccagaagatacccgactgggcaagcgccgggatttcggcgatatggattcctcccgcgagcaagggtatgagcggcggctattcgatgg
gctacgaccctacgattattttgaccttggtgagtactaccagaagggaacggtggaaacgaggttcggctcaaagcaggagctcataaacat
gataaacacggcccatgcctacggcataaaggtcatagcggacatcgtcataaaccaccgcgcaggcggagacctcgagtggaacccgttc
gttggggactacacctggacggacttctcaaaggtggcctcgggcaaatatactgccaactacctcgacttccacccgaacgagctccatgcg
ggcgattccggaacatttggaggctatcccgacatatgccacgacaagagctgggaccagtactggctctgggccagccaggagagctacgc
ggcatatctcaggagcatcggcatcgatgcctggcgcttcgactacgtcaagggctatgctccctgggtcgtcaaggactggctgaactggtgg
gggggctgggcggttggagagtactgggacaccaacgtcgacgctgttctcaactgggcatactcgagcggtgccaaggtctttgacttcgcc
ctctactacaagatggatgaggcctttgacaacaaaaacattccagcgctcgtctctgcccttcagaacggccagactgttgtctcccgcgaccc
gttcaaggccgtaacctttgtagcaaaccacgacaccgatataatttggaacaagtaccggcctacgccttcatcctcacctacgagggccag
ccgacgatattctaccgcgactacgaggagtggctcaacaaggacaggctcaagaacctcatctggatacacgaccacctcgccggtggaag
cactgacatcgttactacgacaacgacgagctgatattcgtgagaaacggctacggaagcaagccgggactgataacatacatcaacctcgc
ctcaagcaaagccggaaggtgggtttatgtgccgaagttcgcgggcgcgtgcatccacgagcatactggtaacctcggaggctgggtagaca
agtacgtctactcaagcggctgggtctatctcgaagctccagcttacgaccctgccaacgggcagtatggctactccgtgtggagctactgcgg
tgttggctga SEQ ID NO.: 20
Met Ala Lys Tyr Leu Glu Leu Glu Glu Gly Gly Leu Ile Met Gln Ala Phe Tyr Trp Asp Val Pro Met
Gly Gly Ile Trp Trp Asp Thr Ile Ala Gln Lys Ile Pro Asp Trp Ala Ser Ala Gly Ile Ser Ala Ile Trp
Ile Pro Pro Ala Ser Lys Gly Met Ser Gly Gly Tyr Ser Met Gly Tyr Asp Pro Tyr Asp Tyr Phe Asp
Leu Gly Glu Tyr Tyr Gln Lys Gly Thr Val Glu Thr Arg Phe Gly Ser Lys Gln Glu Leu Ile Asn Met
Ile Asn Thr Ala His Ala Tyr Gly Ile Lys Val Ile Ala Asp Ile Val Ile Asn His Arg Ala Gly Gly Asp
Leu Glu Trp Asn Pro Phe Val Gly Asp Tyr Thr Trp Thr Asp Phe Ser Lys Val Ala Ser Gly Lys Tyr
Thr Ala Asn Tyr Leu Asp Phe His Pro Asn Glu Leu His Ala Gly Asp Ser Gly Thr Phe Gly Gly Tyr
Pro Asp Ile Cys His Asp Lys Ser Trp Asp Gln Tyr Trp Leu Trp Ala Ser Gln Glu Ser Tyr Ala Ala
Tyr Leu Arg Ser Ile Gly Ile Asp Ala Trp Arg Phe Asp Tyr Val Lys Gly Tyr Ala Pro Trp Val Val
Lys Asp Trp Leu Asn Trp Trp Gly Gly Trp Ala Val Gly Glu Tyr Trp Asp Thr Asn Val Asp Ala Val
Leu Asn Trp Ala Tyr Ser Ser Gly Ala Lys Val Phe Asp Phe Ala Leu Tyr Tyr Lys Met Asp Glu Ala
Phe Asp Asn Lys Asn Ile Pro Ala Leu Val Ser Ala Leu Gln Asn Gly Gln Thr Val Val Ser Arg Asp
Pro Phe Lys Ala Val Thr Phe Val Ala Asn His Asp Thr Asp Ile Ile Trp Asn Lys Tyr Pro Ala Tyr
Ala Phe Ile Leu Thr Tyr Glu Gly Gln Pro Thr Ile Phe Tyr Arg Asp Tyr Glu Glu Trp Leu Asn Lys
Asp Arg Leu Lys Asn Leu Ile Trp Ile His Asp His Leu Ala Gly Gly Ser Thr Asp Ile Val Tyr Tyr
Asp Asn Asp Glu Leu Ile Phe Val Arg Asn Gly Tyr Gly Ser Lys Pro Gly Leu Ile Thr Tyr Ile Asn
Leu Ala Ser Ser Lys Ala Gly Arg Trp Val Tyr Val Pro Lys Phe Ala Gly Ala Cys Ile His Glu His
Thr Gly Asn Leu Gly Gly Trp Val Asp Lys Tyr Val Tyr Ser Ser Gly Trp Val Tyr Leu Glu Ala Pro
Ala Tyr Asp Pro Ala Asn Gly Gln Tyr Gly Tyr Ser Val Trp Ser Tyr Cys Gly Val Gly SEQ ID NO.: 21
atggccaagtactccgagctggaagagggcggcgttataatgcaggccttctactgggacgtcccaggtggaggaatctggtgggacaccat
caggagcaagataccggagtggtacgaggcgggaatatccgccatttggattcctcccgggagcaagggtatgagcggcggctattcgatgg
gctacgaccctacgatgatttggacctgggtgagtactaccagaagggaacggtggaaacgaggttcggctcaaagcaggagctcataaac
atgataaacacggcccatgcctacggcataaaggtcatagcggacatcgtcataaaccaccgcgcaggcggagacctcgagtggaacccgtt
cgttggggactacacctggacggacttctcaaaggtggcctcgggcaaatatactgccaactacctcgacttccacccgaacgagctccatgc
gggcgattccggaacatttggaggctatcccgacatatgccacgacaagagctgggaccagtactggctctgggccagccaggagagctac

Figure 16G gcggtatatctcaggagcatcggcatcgatgcctggcgcttcgactacgtcaagggctacggagcgtgggtcgtcaaggactggctggactg
gtggggaggctgggccgtcggggagtactgggacacaaaacgttgatgcactgctcaactgggcctactcgagcgatgcaaaagtcttcgactt
cccgctctactacaagatggatgaggcctttgacaacaaaaacattccagcgctcgtctctgcccttcagaacggccagactgttgtctcccgcg
acccgttcaaggccgtaacctttgtagcaaaccacgacaccgatataatttggaacaagtacccggcctacgccttcatcctcacctacgaggg
ccagccgacgatattctaccgcgactacgaggagtggctcaacaaggacaggctcaagaacctcatctggatacacgactacctcgccggtg
gaagcactgacatcgtttactacgacaacgacgagctgatattcgtgagaaacggctacggaagcaagccgggactgataacataca??acc
tcgcctcaagcaaagccggaaggtgggtttatgtgccgaagttcgcgggcgcgtgcatccacgagtatactggtaacctcggaggctg. !ag
acaagtacgtctactcaagcggctgggtctatctcgaagctccagcttacgaccctgccaacgggcagtatggctactccgtgtggagcta. ?c
ggtgttggctga SEQ ID NO.: 22
Met Ala Lys Tyr Ser Glu Leu Glu Glu Gly Gly Val Ile Met Gln Ala Phe Tyr Trp Asp Val Pro Gly
Gly Gly Ile Trp Trp Asp Thr Ile Arg Ser Lys Ile Pro Glu Trp Tyr Glu Ala Gly Ile Ser Ala Ile Trp
Ile Pro Pro Gly Ser Lys Gly Met Ser Gly Gly Tyr Ser Met Gly Tyr Asp Pro Tyr Asp Asp Leu Asp
Leu Gly Glu Tyr Tyr Gln Lys Gly Thr Val Glu Thr Arg Phe Gly Ser Lys Gln Glu Leu Ile Asn Met
Ile Asn Thr Ala His Ala Tyr Gly Ile Lys Val Ile Ala Asp Ile Val Ile Asn His Arg Ala Gly Gly Asp
Leu Glu Trp Asn Pro Phe Val Gly Asp Tyr Thr Trp Thr Asp Phe Ser Lys Val Ala Ser Gly Lys Tyr
Thr Ala Asn Tyr Leu Asp Phe His Pro Asn Glu Leu His Ala Gly Asp Ser Gly Thr Phe Gly Gly Tyr
Pro Asp Ile Cys His Asp Lys Ser Trp Asp Gln Tyr Trp Leu Trp Ala Ser Gln Glu Ser Tyr Ala Val
Tyr Leu Arg Ser Ile Gly Ile Asp Ala Trp Arg Phe Asp Tyr Val Lys Gly Tyr Gly Ala Trp Val Val
Lys Asp Trp Leu Asp Trp Trp Gly Gly Trp Ala Val Gly Glu Tyr Trp Asp Thr Asn Val Asp Ala
Leu Leu Asn Trp Ala Tyr Ser Ser Asp Ala Lys Val Phe Asp Phe Pro Leu Tyr Tyr Lys Met Asp Glu
Ala Phe Asp Asn Lys Asn Ile Pro Ala Leu Val Ser Ala Leu Gln Asn Gly Gln Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Arg Leu Lys Asn Leu Ile Trp Ile His Asp Tyr Leu Ala Gly Gly Ser Thr Asp Ile Val Tyr
Tyr Asp Asn Asp Glu Leu Ile Phe Val Arg Asn Gly Tyr Gly Ser Lys Pro Gly Leu Ile Thr Tyr Ile
Asn Leu Ala Ser Ser Lys Ala Gly Arg Trp Val Tyr Val Pro Lys Phe Ala Gly Ala Cys Ile His Glu
Tyr Thr Gly Asn Leu Gly Gly Trp Val Asp Lys Tyr Val Tyr Ser Ser Gly Trp Val Tyr Leu Glu Ala
Pro Ala Tyr Asp Pro Ala Asn Gly Gln Tyr Gly Tyr Ser Val Trp Ser Tyr Cys Gly Val Gly SEQ ID NO.: 23
atggccaagtactccgagctggaagagggcggcgttatagtgcaggccttctactgggacgtcccaggtggaggaatctggtgggacaccat
caggagcaagataccggagtggtacgaggcgggaatatccgccatttggattccccggcgagcaagggcatgggcggcgcctattcgatg
ggctacgaccccctacgacttctttgacctcggtgagtacgaccagaagggaacggtagagacgcgctttggctccaagcaggagctcgtgaa
catgataaacacggcccatgcctacggcataaaggtcatagcggacatcgtcataaaccaccgcgcaggcggagacctcgagtggaacccg
ttcgttggggactacacctggacggacttctcaaaggtggcctcgggcaaatatactgccaactacctcgacttccacccgaacgagctccatg
cgggcgattccggaacatttggaggctatcccgacatatgccacgacaagagctgggaccagtactggctctgggccagccaggagagctac
gcggcatatctcaggagcatcggcatcgatgcctggcgcttcgactacgtcaagggctacggagcgtgggtcgtcaaggactggctggactg
gtggggaggctgggccgtcggggagtactgggacacaaaacgttgatgcactgctcaactgggcctactcgagcgatgcaaaagtcttcgactt
cccgctctactacaagatggatgaggcctttgacaacaaaaacattccagcgctcgtctctgcccttcagaacggccagactgttgtctcccgcg
acccgttcaaggccgtaacctttgtagcaaaccacgacaccgatataatctggaacaagtatccagcctacgcgttcatcctcacctacgaggg
ccagccgacaatattctaccgcgactacgaggagtggctcaacaaggataagctcaagaacctcatctggatacatgacaacctcgccggag
gaagcatgagcatagtttactacgacagcgacgagatgatcttcgtgaggaacggctatggaagcaagcctggccttataacttacatcaacctc
ggctcgagcaaggttggaaggtgggtctacgttccgaagttcgcgggagcgtgcatccacgagtacaccggcaacctcggcggctgggtgg
acaagtgggtggactcaagcgggtgggtgtacctcgaggcccctgcccacgacccggccaacggctattacggctactccgtctggagctatt
gcggtgttggctga

SEQ ID NO.: 24

Figure 16H

Met Ala Lys Tyr Ser Glu Leu Glu Glu Gly Gly Val Ile Val Gln Ala Phe Tyr Trp Asp Val Pro Gly
Gly Gly Ile Trp Trp Asp Thr Ile Arg Ser Lys Ile Pro Glu Trp Tyr Glu Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly Gly
Asp Leu Glu Trp Asn Pro Phe Val Gly Asp Tyr Thr Trp Thr Asp Phe Ser Lys Val Ala Ser Gly Lys
Tyr Thr Ala Asn Tyr Leu Asp Phe His Pro Asn Glu Leu His Ala Gly Asp Ser Gly Thr Phe Gly Gly
Tyr Pro Asp Ile Cys His Asp Lys Ser Trp Asp Gln Tyr Trp Leu Trp Ala Ser Gln Glu Ser Tyr Ala
Ala Tyr Leu Arg Ser Ile Gly Ile Asp Ala Trp Arg Phe Asp Tyr Val Lys Gly Tyr Gly Ala Trp Val
Val Lys Asp Trp Leu Asp Trp Trp Gly Gly Trp Ala Val Gly Glu Tyr Trp Asp Thr Asn Val Asp Ala
Leu Leu Asn Trp Ala Tyr Ser Ser Asp Ala Lys Val Phe Asp Phe Pro Leu Tyr Tyr Lys Met Asp Glu
Ala Phe Asp Asn Lys Asn Ile Pro Ala Leu Val Ser Ala Leu Gln Asn Gly Gln Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Lys Leu Lys Asn Leu Ile Trp Ile His Asp Asn Leu Ala Gly Gly Ser Met Ser Ile Val Tyr
Tyr Asp Ser Asp Glu Met Ile Phe Val Arg Asn Gly Tyr Gly Ser Lys Pro Gly Leu Ile Thr Tyr Ile
Asn Leu Gly Ser Ser Lys Val Gly Arg Trp Val Tyr Val Pro Lys Phe Ala Gly Ala Cys Ile His Glu
Tyr Thr Gly Asn Leu Gly Gly Trp Val Asp Lys Trp Val Asp Ser Ser Gly Trp Val Tyr Leu Glu Ala
Pro Ala His Asp Pro Ala Asn Gly Tyr Tyr Gly Tyr Ser Val Trp Ser Tyr Cys Gly Val Gly

SEQ ID NO.: 25
atggccaagtacctggagctcgaagagggcgggctcataatgcaggccttctactgggacgtccccatgggaggaatctggtgggacacgat
agcccagaagatacccgactgggcaagcgccgggatttcggcgatatggattcctcccgcgagcaagggtatgagcggcggctattcgatgg
gctacgaccccctacgattattttgacctcggtgagtactaccagaagggaacggtggaaacgaggttcggctcaaagcaggagctcataaacat
gataaacaccgcccacgcctatggcatgaaggtaatagccgatatagtcatcaaccaccgcgccggcggtgacctggagtggaacccct tcgt
gaacgactatacctggaccgacttctcaaaggtcgcgtcgggtaaatacacggccaactacctcgacttccacccgaacgagctccatgcggg
cgattccggaacatttggaggctatcccgacatatgccacgacaagagctgggaccagtactggctctgggccagccaggagagctacgcgg
catatctcaggagcatcggcatcgatgcctggcgcttcgactacgtcaagggctatgctccctgggtcgtcaaggactggctgaactggtgggg
aggctgggcggttggagagtactgggacaccaacgtcgacgctgttctcaactgggcatactcgagcggtgccaaggtctttgacttcgccctc
tactacaagatggacgaggccttcgataacaacaacattcccgccctggtgggcgccctcagatacggtcagacagtggtcagccgcgaccc
gttcaaggctgtgacgtttgtagccaaccacgataccgatataatctggaacaagtatccagcctacgcgttcatcctcacctacgagggccagc
cgacaatattctaccgcgactacgaggagtggctcaacaaggataagctcaagaacctcatctggatacatgacaacctcgccggaggaagc
accgacatagtctactacgataacgatgaactcatcttcgtcaggcacggctacggggacaagccggggcttataacctacatcaacctaggct
cgagcaaggccggaaggtgggtttacgttccgaagttcgcaggctcgtgcatacacgagtacaccggcaatctcggcggctgggtggacaa
gtgggtggactcaagcggctgggtctacctcgaggctcctgcccacgacccggccaacggccagtacggctactccgtctggagctattgcg
gtgttgggtga SEQ ID NO.: 26
Met Ala Lys Tyr Leu Glu Leu Glu Glu Gly Gly Leu Ile Met Gln Ala Phe Tyr Trp Asp Val Pro Met
Gly Gly Ile Trp Trp Asp Thr Ile Ala Gln Lys Ile Pro Asp Trp Ala Ser Ala Gly Ile Ser Ala Ile Trp
Ile Pro Pro Ala Ser Lys Gly Met Ser Gly Gly Tyr Ser Met Gly Tyr Asp Pro Tyr Asp Tyr Phe Asp
Leu Gly Glu Tyr Tyr Gln Lys Gly Thr Val Glu Thr Arg Phe Gly Ser Lys Gln Glu Leu Ile Asn Met
Ile Asn Thr Ala His Ala Tyr Gly Met Lys Val Ile Ala Asp Ile Val Ile Asn His Arg Ala Gly Gly Asp
Leu Glu Trp Asn Pro Phe Val Asn Asp Tyr Thr Trp Thr Asp Phe Ser Lys Val Ala Ser Gly Lys Tyr
Thr Ala Asn Tyr Leu Asp Phe His Pro Asn Glu Leu His Ala Gly Asp Ser Gly Thr Phe Gly Gly Tyr
Pro Asp Ile Cys His Asp Lys Ser Trp Asp Gln Tyr Trp Leu Trp Ala Ser Gln Glu Ser Tyr Ala Ala
Tyr Leu Arg Ser Ile Gly Ile Asp Ala Trp Arg Phe Asp Tyr Val Lys Gly Tyr Ala Pro Trp Val Val
Lys Asp Trp Leu Asn Trp Trp Gly Gly Trp Ala Val Gly Glu Tyr Trp Asp Thr Asn Val Asp Ala Val
Leu Asn Trp Ala Tyr Ser Ser Gly Ala Lys Val Phe Asp Phe Ala Leu Tyr Tyr Lys Met Asp Glu Ala
Phe Asp Asn Asn Asn Ile Pro Ala Leu Val Gly Ala Leu Arg Tyr Gly Gln Thr Val Val Ser Arg Asp

Figure 16I

Pro Phe Lys Ala Val Thr Phe Val Ala Asn His Asp Thr Asp Ile Ile Trp Asn Lys Tyr Pro Ala Tyr
Ala Phe Ile Leu Thr Tyr Glu Gly Gln Pro Thr Ile Phe Tyr Arg Asp Tyr Glu Glu Trp Leu Asn Lys
Asp Lys Leu Lys Asn Leu Ile Trp Ile His Asp Asn Leu Ala Gly Gly Ser Thr Asp Ile Val Tyr Tyr
Asp Asn Asp Glu Leu Ile Phe Val Arg His Gly Tyr Gly Asp Lys Pro Gly Leu Ile Thr Tyr Ile Asn
Leu Gly Ser Ser Lys Ala Gly Arg Trp Val Tyr Val Pro Lys Phe Ala Gly Ser Cys Ile His Glu Tyr
Thr Gly Asn Leu Gly Gly Trp Val Asp Lys Trp Val Asp Ser Ser Gly Trp Val Tyr Leu Glu Ala Pro
Ala His Asp Pro Ala Asn Gly Gln Tyr Gly Tyr Ser Val Trp Ser Tyr Cys Gly Val Gly

SEQ ID NO.: 27
atggcaaagtattccgagctcgaagagggcggcgttataatgcaggccttctactgggacgtcccaggtggaggaatctggtgggacaccatc
aggagcaagataccggagtggtacgaggcgggaatatccgccatttggattcctcccgcgagcaagggtatgagcggcggctattcgatggg
ctacgaccctacgattattttgacctcggtgagtactaccagaagggaacggtggaaacgaggttcggctcaaagcaggagctcataaacatg
ataaacacggcccatgcctacggcataaaggtcatagcggacatcgtcataaaccaccgcgcaggcggagacctcgagtggaacccgttcgt
tggggactacacctggacggacttctcaaaggtggcctcgggcaaatatactgccaactacctcgacttccacccgaacgagctccatgcggg
cgattccggaacatttggaggctatcccgacatatgccacgacaagagctgggaccagtactggctctgggccagccaggagagctacgcgg
catatctcaggagcatcggcatcgatgcctggcgcttcgactacgtcaagggctatgctccctgggtcgtcaaggactggctgaactggtgggg
aggctggccggttggagagtactgggacaccaacgtcgacgctgttctcaactgggcatactcgagcggtgccaaggtctttgacttcgccctc
tactacaagatggacgcggcctttgacaacaagaacattcccgcactcgtcgaggccctcaagaacgggggcacagtcgtcagccgcgacc
cgtttaaggccgtaaccttcgttcaaaccacgacaccgatataatctggaacaagtatccagcctacgcgttcatcctcacctacgagggccag
ccgacaatattctaccgcgactacgaggagtggctcaacaaggataagctcaagaacctcatctggatacatgacaacctcgccggaggaag
cactgacatcgtttactacgacaacgacgagctgatattcgtgagaaacggctacggaagcaagccgggactgataacatacatcaacctcgc
gtcaagcaaagccggaaggtgggtttacgttccgaagttcgcaggctcgtgcatacacgagtacaccggcaatctcggcggctgggtggaca
agtgggtggactcaagcggctgggtctacctcgaggctcctgcccacgacccggccaacggccagtacggctactccgtctggagctactgc
ggtgttgggtga SEQ ID NO.: 28
Met Ala Lys Tyr Ser Glu Leu Glu Glu Gly Gly Val Ile Met Gln Ala Phe Tyr Trp Asp Val Pro Gly
Gly Gly Ile Trp Trp Asp Thr Ile Arg Ser Lys Ile Pro Glu Trp Tyr Glu Ala Gly Ile Ser Ala Ile Trp
Ile Pro Pro Ala Ser Lys Gly Met Ser Gly Gly Tyr Ser Met Gly Tyr Asp Pro Tyr Asp Tyr Phe Asp
Leu Gly Glu Tyr Tyr Gln Lys Gly Thr Val Glu Thr Arg Phe Gly Ser Lys Gln Glu Leu Ile Asn Met
Ile Asn Thr Ala His Ala Tyr Gly Ile Lys Val Ile Ala Asp Ile Val Ile Asn His Arg Ala Gly Gly Asp
Leu Glu Trp Asn Pro Phe Val Gly Asp Tyr Thr Trp Thr Asp Phe Ser Lys Val Ala Ser Gly Lys Tyr
Thr Ala Asn Tyr Leu Asp Phe His Pro Asn Glu Leu His Ala Gly Asp Ser Gly Thr Phe Gly Gly Tyr
Pro Asp Ile Cys His Asp Lys Ser Trp Asp Gln Tyr Trp Leu Trp Ala Ser Gln Glu Ser Tyr Ala Ala
Tyr Leu Arg Ser Ile Gly Ile Asp Ala Trp Arg Phe Asp Tyr Val Lys Gly Tyr Ala Pro Trp Val Val
Lys Asp Trp Leu Asn Trp Trp Gly Gly Trp Ala Val Gly Glu Tyr Trp Asp Thr Asn Val Asp Ala Val
Leu Asn Trp Ala Tyr Ser Ser Gly Ala Lys Val Phe Asp Phe Ala Leu Tyr Tyr Lys Met Asp Ala Ala
Phe Asp Asn Lys Asn Ile Pro Ala Leu Val Glu Ala Leu Lys Asn Gly Gly Thr Val Val Ser Arg Asp
Pro Phe Lys Ala Val Thr Phe Val Ala Asn His Asp Thr Asp Ile Ile Trp Asn Lys Tyr Pro Ala Tyr
Ala Phe Ile Leu Thr Tyr Glu Gly Gln Pro Thr Ile Phe Tyr Arg Asp Tyr Glu Glu Trp Leu Asn Lys
Asp Lys Leu Lys Asn Leu Ile Trp Ile His Asp Asn Leu Ala Gly Gly Ser Thr Asp Ile Val Tyr Tyr
Asp Asn Asp Glu Leu Ile Phe Val Arg Asn Gly Tyr Gly Ser Lys Pro Gly Leu Ile Thr Tyr Ile Asn
Leu Ala Ser Ser Lys Ala Gly Arg Trp Val Tyr Val Pro Lys Phe Ala Gly Ser Cys Ile His Glu Tyr
Thr Gly Asn Leu Gly Gly Trp Val Asp Lys Trp Val Asp Ser Ser Gly Trp Val Tyr Leu Glu Ala Pro
Ala His Asp Pro Ala Asn Gly Gln Tyr Gly Tyr Ser Val Trp Ser Tyr Cys Gly Val Gly SEQ ID NO.: 29
atggccaagtacctggagctcgaagagggcgggctcataatgcaggccttctactgggacgtccccatgggaggaatctggtgggacacggt
agcccagaagataccogactgggcaagcgccgggatttcggcgatatggattccccggcgagcaagggcatgggcggcgcctattcgatg
ggctacgaccctacgacttctttgacctcggtgagtacgaccagaagggaacggtagagacgcgctttggctccaagcaggagctcgtgaa

Figure 16J

SEQ ID NO.: 32
Met Ala Lys Tyr Ser Glu Leu Glu Glu Gly Gly Val Ile Met Gln Ala Phe Tyr Trp Asp Val Pro Gly
Gly Gly Ile Trp Trp Asp Thr Ile Arg Ser Arg Ile Pro Glu Trp Tyr Glu Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly
Asp Leu Glu Trp Asn Pro Phe Val Gly Asp Tyr Thr Trp Thr Asp Phe Ser Lys Val Ala Ser Gly Ly
Tyr Thr Ala Asn Tyr Leu Asp Phe His Pro Asn Glu Leu His Ala Gly Asp Ser Gly Thr Phe Gly Gly
Tyr Pro Asp Ile Cys His Asp Lys Ser Trp Asp Gln Tyr Trp Leu Trp Ala Ser Gln Glu Ser Tyr Ala
Ala Tyr Leu Arg Ser Ile Gly Ile Asp Ala Trp Arg Phe Asp Tyr Val Lys Gly Tyr Gly Ala Trp Val
Val Lys Asp Trp Leu Asn Trp Trp Gly Gly Trp Ala Val Gly Glu Tyr Trp Asp Thr Asn Val Asp Ala
Leu Leu Asn Trp Ala Tyr Ser Ser Gly Ala Lys Val Phe Asp Phe Pro Leu Tyr Tyr Lys Met Asp Glu
Ala Phe Asp Asn Asn Asn Ile Pro Ala Leu Val Asp Ala Leu Arg Tyr Gly Gln Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Lys Leu Lys Asn Leu Ile Trp Ile His Asp Asn Leu Ala Gly Gly Ser Thr Ser Ile Val Tyr
Tyr Asp Ser Asp Glu Met Ile Phe Val Arg Thr Gly Tyr Gly Ser Lys Pro Gly Leu Ile Thr Tyr Ile
Asn Leu Gly Ser Ser Lys Val Gly Arg Trp Val Tyr Val Pro Lys Phe Ala Gly Ala Cys Ile His Glu
Tyr Thr Gly Asn Leu Gly Gly Trp Val Asp Lys Tyr Val Tyr Ser Ser Gly Trp Val Tyr Leu Glu Ala
Pro Ala Tyr Asp Pro Ala Asn Gly Gln Tyr Gly Tyr Ser Val Trp Ser Tyr Cys Gly Val Gly

SEQ ID NO.: 33
atggccaagtactccgagctggaagagggcggggtcataatgcaggcgttctactgggacgtgccttcaggaggaatatggtgggacacaat
acggcagaagataccggagtggtacgatgccggaatctccgcaatatggattcctcccgcgagcaagggtatgagcggcggctattcgatgg
gctacgaccccctacgattattttgacctcggtgagtactaccagaagggaacggtggaaacgaggttcggctcaaagcaggagctcataaacat
gataaacacggcccatgcctacggcataaaggtcatagcggacatcgtcataaaccaccgcgcaggcggagacctcgagtggaacccgttc
gttggggactacacctggacggacttctcaaaggtggcctcgggcaaatatactgccaactacctcgacttccacccgaacgagctccatgcg
ggcgattccggaacatttggaggctatccgacatatgccacgacaagagctgggaccagtactggctctgggccagccaggagagctacgc
ggcatatctcaggagcatcggcatcgatgcctggcgctttgactacgtgaaggggctacggagcgtgggtcgtcaaggactggctcaactggtg
gggcggctgggccgttggcgagtactgggacaccaacgttgatgcactcctcaactgggcctactcgagcggcgccaaggtcttcgactttcc
gctctactacaagatggacgcggcctttgacaacaagaacattcccgcactcgtcgaggccctcaagaacggggggcacagtcgtcagccgcg
acccgtttaaggccgtaaccttcgttgcaaaccacgacaccgatataatctggaccaagtaccttgcttatgctttcatcctcacctacgaaggcca
gcccgtcatattctaccgcgactacgaggagtggctcaacaaggacaggttgaacaacctcatatggatacacgaccacctcgcaggtggaag
caccgacatagtctactacgataacgatgaactcatcttcgtcaggaacggctacggggacaagccggggcttataacctacatcaacctaggc
tcgagcaaggccggaaggtgggtttacgttccgaagttcgcaggctcgtgcatacacgagtacaccggcaatctcggcggctgggtggacaa
gtgggtggactcaagcggctgggtctacctcgaggctcctgcccacgacccggccaacggccagtacggctactccgtctggagctactgcg
gtgttggctga SEQ ID NO.: 34
Met Ala Lys Tyr Ser Glu Leu Glu Glu Gly Gly Val Ile Met Gln Ala Phe Tyr Trp Asp Val Pro Ser
Gly Gly Ile Trp Trp Asp Thr Ile Arg Gln Lys Ile Pro Glu Trp Tyr Asp Ala Gly Ile Ser Ala Ile Trp
Ile Pro Pro Ala Ser Lys Gly Met Ser Gly Gly Tyr Ser Met Gly Tyr Asp Pro Tyr Asp Tyr Phe Asp
Leu Gly Glu Tyr Tyr Gln Lys Gly Thr Val Glu Thr Arg Phe Gly Ser Lys Gln Glu Leu Ile Asn Met
Ile Asn Thr Ala His Ala Tyr Gly Ile Lys Val Ile Ala Asp Ile Val Ile Asn His Arg Ala Gly Gly Asp
Leu Glu Trp Asn Pro Phe Val Gly Asp Tyr Thr Trp Thr Asp Phe Ser Lys Val Ala Ser Gly Lys Tyr
Thr Ala Asn Tyr Leu Asp Phe His Pro Asn Glu Leu His Ala Gly Asp Ser Gly Thr Phe Gly Gly Tyr
Pro Asp Ile Cys His Asp Lys Ser Trp Asp Gln Tyr Trp Leu Trp Ala Ser Gln Glu Ser Tyr Ala Ala
Tyr Leu Arg Ser Ile Gly Ile Asp Ala Trp Arg Phe Asp Tyr Val Lys Gly Tyr Gly Ala Trp Val Val
Lys Asp Trp Leu Asn Trp Trp Gly Gly Trp Ala Val Gly Glu Tyr Trp Asp Thr Asn Val Asp Ala

Figure 16K catgataaacacggcccatgcctacggcataaaggtcatagcggacatcgtcataaaccaccgcgcaggcggagacctcgagtggaacccg
ttcgttggggactacacctggacggacttctcaaaggtggtctcgggcaaatatactgccaactacctcgacttccacccgaacgagctccatgc
gggcgattccggaacatttggaggctatcccgacatatgccacgacaagagctgggaccagtactggctctgggccagccaggagagctac
gcggcatatctcaggagcatcggcatcgatgcctggcgcttcgactacgtcaaggcgtatgctccctgggtcgtcaaggactggctgaactggt
ggggaggctgggcggttggagagtactgggacaccaacgtcgacgctgttctcaactgggcatactcgagcggtgccaaggtctttgacttcg
ccctctactacaagatggatgaggcctttgacaacaaaaacattccagcgctcgtctctgcccttcagaacggccagactgttgtctcccgcgac
ccgttcaaggccgtaacctttgtagcaaaccacgacaccgatataatctggaacaagtaccttgcttatgccttcatcctcacctacgaaggccag
cccgtcatattctaccgcgactacgaggagtggctcaacaaggacaggttgaacaacctcatatggatacacgaccacctcgcaggggggaag
caccgacatagtctactacgataacgatgaactcatcttcgtcaggaacggctacggggacaagccggggcttataacctacatcaacctaggc
tcgagcaaggccggaaggtgggtttatgtgccgaagttcgcgggcgcgtgcatccacgagtatactggtaacctcggaggctgggtagacaa
gtacgtctactcaagcggctgggtctatctcgaagctccagcttacgaccctgccaacgggcagtatggctactccgtgtggagctactgcggt
gttgggtga SEQ ID NO.: 30
Met Ala Lys Tyr Leu Glu Leu Glu Glu Gly Gly Leu Ile Met Gln Ala Phe Tyr Trp Asp Val Pro Met
Gly Gly Ile Trp Trp Asp Thr Val Ala Gln Lys Ile Pro Asp Trp Ala Ser Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly Gly
Asp Leu Glu Trp Asn Pro Phe Val Gly Asp Tyr Thr Trp Thr Asp Phe Ser Lys Val Val Ser Gly Lys
Tyr Thr Ala Asn Tyr Leu Asp Phe His Pro Asn Glu Leu His Ala Gly Asp Ser Gly Thr Phe Gly Gly
Tyr Pro Asp Ile Cys His Asp Lys Ser Trp Asp Gln Tyr Trp Leu Trp Ala Ser Gln Glu Ser Tyr Ala
Ala Tyr Leu Arg Ser Ile Gly Ile Asp Ala Trp Arg Phe Asp Tyr Val Lys Gly Tyr Ala Pro Trp Val
Val Lys Asp Trp Leu Asn Trp Trp Gly Gly Trp Ala Val Gly Glu Tyr Trp Asp Thr Asn Val Asp Ala
Val Leu Asn Trp Ala Tyr Ser Ser Gly Ala Lys Val Phe Asp Phe Ala Leu Tyr Tyr Lys Met Asp Glu
Ala Phe Asp Asn Lys Asn Ile Pro Ala Leu Val Ser Ala Leu Gln Asn Gly Gln Thr Val Val Ser Arg
Asp Pro Phe Lys Ala Val Thr Phe Val Ala Asn His Asp Thr Asp Ile Ile Trp Asn Lys Tyr Leu Ala
Tyr Ala Phe Ile Leu Thr Tyr Glu Gly Gln Pro Val Ile Phe Tyr Arg Asp Tyr Glu Glu Trp Leu Asn
Lys Asp Arg Leu Asn Asn Leu Ile Trp Ile His Asp His Leu Ala Gly Gly Ser Thr Asp Ile Val Tyr
Tyr Asp Asn Asp Glu Leu Ile Phe Val Arg Asn Gly Tyr Gly Asp Lys Pro Gly Leu Ile Thr Tyr Ile
Asn Leu Gly Ser Ser Lys Ala Gly Arg Trp Val Tyr Val Pro Lys Phe Ala Gly Ala Cys Ile His Glu
Tyr Thr Gly Asn Leu Gly Gly Trp Val Asp Lys Tyr Val Tyr Ser Ser Gly Trp Val Tyr Leu Glu Ala
Pro Ala Tyr Asp Pro Ala Asn Gly Gln Tyr Gly Tyr Ser Val Trp Ser Tyr Cys Gly Val Gly SEQ ID NO.: 31
atggcaaagtactccgagctggaagagggcggcgttataatgcaggccttctactgggacgtcccaggtggaggaatctggtgggacaccat
caggagcaggataccggagtggtacgaggcgggaatatccgccatttggattccccggcgagcaagggcatggcggcgcctattcgatg
ggctacgaccctacgacttctttgacctcggtgagtacgaccagaagggaacggtagagacgcgctttggctccaagcaggagctcgtgaa
catgataaacacggcccatgcctacggcataaaggtcatagcggacatcgtcataaaccaccgcgcaggcggagacctcgagtggaacccg
ttcgttggggactacacctggacggacttctcaaaggtggcctcgggcaaatatactgccaactacctcgacttccacccgaacgagctccatg
cgggcgattccggaacatttggaggctatcccgacatatgccacgacaagagctgggaccagtactggctctgggccagccaggagagctac
gcggcatatctcaggagcatcggcatcgatgcctggcgctttgactacgtgaagggctacggagcgtgggtcgtcaaggactggctcaactgg
tggggcggctgggccgttggcgagtactgggacaccaacgttgatgcactcctcaactgggcctactcgagcggcgccaaggtcttcgacttc
ccgctctactacaagatggacgaggccttcgataacaacaacattcccgccctggtggacgccctcagatacggtcagacagtggtcagccgc
gacccgttcaaggctgtgacgtttgtagccaaccacgataccgatataatctggaacaagtatccagcctacgcgttcatcctcacctacgaggg
ccagccgacaatattctaccgcgactacgaggagtggctcaacaaggataagctcaagaacctcatctggatacatgacaacctggccggag
gaagcacgagcatagtttactacgacagcgacgagatgatcttcgtgaggaccggctatggaagcaagcctggccttataacttacatcaacct
cggctcgagcaaggttggaaggtgggtttatgtgccgaagttcgcgggcgcgtgcatccacgagtatactggtaacctcggaggctgggtaga
caagtacgtctactcaagcggctgggtctatctcgaagctccagcttacgaccctgccaacgggcagtatggctactccgtgtggagctattgcg
gtgttggctga

Figure 16L

Leu Leu Asn Trp Ala Tyr Ser Ser Gly Ala Lys Val Phe Asp Phe Pro Leu Tyr Tyr Lys Met Asp Ala
Ala Phe Asp Asn Lys Asn Ile Pro Ala Leu Val Glu Ala Leu Lys Asn Gly Gly Thr Val Val Ser Arg
Asp Pro Phe Lys Ala Val Thr Phe Val Ala Asn His Asp Thr Asp Ile Ile Trp Thr Lys Tyr Leu Ala
Tyr Ala Phe Ile Leu Thr Tyr Glu Gly Gln Pro Val Ile Phe Tyr Arg Asp Tyr Glu Glu Trp Leu Asn
Lys Asp Arg Leu Asn Asn Leu Ile Trp Ile His Asp His Leu Ala Gly Gly Ser Thr Asp Ile Val Tyr
Tyr Asp Asn Asp Glu Leu Ile Phe Val Arg Asn Gly Tyr Gly Asp Lys Pro Gly Leu Ile Thr Tyr Ile
Asn Leu Gly Ser Ser Lys Ala Gly Arg Trp Val Tyr Val Pro Lys Phe Ala Gly Ser Cys Ile His Glu
Tyr Thr Gly Asn Leu Gly Gly Trp Val Asp Lys Trp Val Asp Ser Ser Gly Trp Val Tyr Leu Glu Ala
Pro Ala His Asp Pro Ala Asn Gly Gln Tyr Gly Tyr Ser Val Trp Ser Tyr Cys Gly Val Gly

SEQ ID NO.: 35
atggccaagtactccgagctggaagagggcggcgttataatgcaggccttctactgggacgtcccaggtggaggaatctggtgggacaccat
caggagcaagataccggagtggtacgaggcgggaatatccgccatttggattccccggcgagcaagggcatgggcggcgcctattcgatg
ggctacgaccctacgacttctttgacctcggtgagtacgaccagaagggaacggtagagacgcgctttggctccaagcaggagctcgtgaa
catgataaacaccgcccacgcctacggcatcaaggtcatcgcagacatagtaatcaaccaccgcgccggaggagaccttgagtggaacccct
tcgtcaatgactacacctggacggacttctcgaaggtcgcttccggcaagtacacggccaactacctcgacttccaccccaacgaggtcaagtg
ctgtgacgagggcacatttggaggcttcccagacatagcccacgagaagagctgggaccagcactggctctgggcgagcgatgagagctac
gccgcctacctaaggagcatcggcgttgatgcctggcgcttcgactacgtcaagggctatgctccctgggtcgtcaaggactggctgaactggt
ggggaggctgggcggttggagagtactgggacaccaacgtcgacgctgttctcaactgggcatactcgagcggtgccaaggtctttgacttcg
ccctctactacaagatggacgcggcctttgacaacaagaacattcccgcactcgtcgaggccctcaagaacgggggcacagtcgtcagccgc
gacccgtttaaggccgtaaccttcgttgcaaaccacgacaccgatataatctggaacaagtatccagcctacgcgttcatcctcacctacgaggg
ccagccgacaatattctaccgcgactacgaggagtggctcaacaaggataagctcaagaacctcatctggatacatgacaacgtcgccggag
gaagcaccgacatagtctactacgataacgatgaactcatcttcgtcaggaacggctacggggacaagccgggggcttataacctacatcaacct
aggctcgagcaaggccggaaggtgggtttacgttccgaagttcgcaggctcgtgcatacacgagtacaccggcaatctcggcggctgggtgg
acaagtgggtggactcaagcggctgggtctacctcgaggctcctgcccacgacccggccaacggccagtacggctactccgtctggagctac
tgcggtgttgggtga SEQ ID NO.: 36
Met Ala Lys Tyr Ser Glu Leu Glu Glu Gly Gly Val Ile Met Gln Ala Phe Tyr Trp Asp Val Pro Gly
Gly Gly Ile Trp Trp Asp Thr Ile Arg Ser Lys Ile Pro Glu Trp Tyr Glu Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly Gly
Asp Leu Glu Trp Asn Pro Phe Val Asn Asp Tyr Thr Trp Thr Asp Phe Ser Lys Val Ala Ser Gly Lys
Tyr Thr Ala Asn Tyr Leu Asp Phe His Pro Asn Glu Val Lys Cys Cys Asp Glu Gly Thr Phe Gly
Gly Phe Pro Asp Ile Ala His Glu Lys Ser Trp Asp Gln His Trp Leu Trp Ala Ser Asp Glu Ser Tyr
Ala Ala Tyr Leu Arg Ser Ile Gly Val Asp Ala Trp Arg Phe Asp Tyr Val Lys Gly Tyr Ala Pro Trp
Val Val Lys Asp Trp Leu Asn Trp Trp Gly Gly Trp Ala Val Gly Glu Tyr Trp Asp Thr Asn Val Asp
Ala Val Leu Asn Trp Ala Tyr Ser Ser Gly Ala Lys Val Phe Asp Phe Ala Leu Tyr Tyr Lys Met Asp
Ala Ala Phe Asp Asn Lys Asn Ile Pro Ala Leu Val Glu Ala Leu Lys Asn Gly Gly Thr Val Val Ser
Arg Asp Pro Phe Lys Ala Val Thr Phe Val Ala Asn His Asp Thr Asp Ile Ile Trp Asn Lys Tyr Pro
Ala Tyr Ala Phe Ile Leu Thr Tyr Glu Gly Gln Pro Thr Ile Phe Tyr Arg Asp Tyr Glu Glu Trp Leu
Asn Lys Asp Lys Leu Lys Asn Leu Ile Trp Ile His Asp Asn Val Ala Gly Gly Ser Thr Asp Ile Val
Tyr Tyr Asp Asn Asp Glu Leu Ile Phe Val Arg Asn Gly Tyr Gly Asp Lys Pro Gly Leu Ile Thr Tyr
Ile Asn Leu Gly Ser Ser Lys Ala Gly Arg Trp Val Tyr Val Pro Lys Phe Ala Gly Ser Cys Ile His
Glu Tyr Thr Gly Asn Leu Gly Gly Trp Val Asp Lys Trp Val Asp Ser Ser Gly Trp Val Tyr Leu Glu
Ala Pro Ala His Asp Pro Ala Asn Gly Gln Tyr Gly Tyr Ser Val Trp Ser Tyr Cys Gly Val Gly SEQ ID NO.: 71
atggccaagtacctggagctcgaagagggcggggtcataatgcaggcgttctactgggacgtgccttcaggaggaatatggtgggacacaat

Figure 16M acggcagaagataccggagtggtacgatgccggaatctccgcaatatggattccccggcgagcaagggcatgggcggcgcctattcgatg
ggctacgacccctacgacttctttgacctcggtgagtacgaccagaagggaacggtagagacgcgctttggctccaagcaggagctcgtgaa
catgataaacacggcccatgcctacggcataaaggtcatagcggacatcgtcataaaccaccgcgcaggcggagacctcgagtggaacccg
ttcgttggggactacacctggacggacttctcaaaggtagcctcgggcaaatatactgccaactacctcgacttccacccgaacgagctccatg
cgggcgattccggaacatttggaggctatcccgacatatgccacgacaagagctgggaccagtactggctctgggccagccaggagagctac
gcggcatatctcaggagcatcggcatcgatgcctggcgcttcgactacgtcaaggctatgctccctgggtcgtcaaggactggctgaactggt
ggggaggctgggcggttggagagtactgggacaccaacgtcgacgctgttctcaactgggcatactcgagcggtgccaaggtctttgacttcg
ccctctactacaagatggatgaggcctttgacaacaaaaacattccagcgctcgtctctgcccttcagaacggccagactgttgtctcccgcgac
ccgttcaaggccgtaacctttgtagcaaaccacgacaccgatataatctggaacaagtatccagcctacgcgttcatcctcacctacgagggcc
agccgacaatattctaccgcgactacgaggagtggctcaacaaggataagctcaagaacctcatctggatacatgacaacctcgccggagga
agcactgacatcgtttactacgacaacgacgagctgatattcgtgagaaacggctacggaagcaagcccgggactgataacatacatcaacctc
gcctcaagcaaagccggaaggtgggtttatgtgccgaagttcgcgggcgcgtgcatccacgagtatactggtaacctcggaggctgggtaga
caagtacgtctactcaagcggctgggtctatctcgaagctccagcttacgaccctgccaacgggcagtatggctactccgtgtggagctactgc
ggggtgggctga SEQ ID NO.: 72
Met Ala Lys Tyr Leu Glu Leu Glu Glu Gly Gly Val Ile Met Gln Ala Phe Tyr Trp Asp Val Pro Ser
Gly Gly Ile Trp Trp Asp Thr Ile Arg Gln Lys Ile Pro Glu Trp Tyr Asp Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly Gly
Asp Leu Glu Trp Asn Pro Phe Val Gly Asp Tyr Thr Trp Thr Asp Phe Ser Lys Val Ala Ser Gly Lys
Tyr Thr Ala Asn Tyr Leu Asp Phe His Pro Asn Glu Leu His Ala Gly Asp Ser Gly Thr Phe Gly Gly
Tyr Pro Asp Ile Cys His Asp Lys Ser Trp Asp Gln Tyr Trp Leu Trp Ala Ser Gln Glu Ser Tyr Ala
Ala Tyr Leu Arg Ser Ile Gly Ile Asp Ala Trp Arg Phe Asp Tyr Val Lys Gly Tyr Ala Pro Trp Val
Val Lys Asp Trp Leu Asn Trp Trp Gly Gly Trp Ala Val Gly Glu Tyr Trp Asp Thr Asn Val Asp Ala
Val Leu Asn Trp Ala Tyr Ser Ser Gly Ala Lys Val Phe Asp Phe Ala Leu Tyr Tyr Lys Met Asp Glu
Ala Phe Asp Asn Lys Asn Ile Pro Ala Leu Val Ser Ala Leu Gln Asn Gly Gln Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Lys Leu Lys Asn Leu Ile Trp Ile His Asp Asn Leu Ala Gly Gly Ser Thr Asp Ile Val Tyr
Tyr Asp Asn Asp Glu Leu Ile Phe Val Arg Asn Gly Tyr Gly Ser Lys Pro Gly Leu Ile Thr Tyr Ile
Asn Leu Ala Ser Ser Lys Ala Gly Arg Trp Val Tyr Val Pro Lys Phe Ala Gly Ala Cys Ile His Glu
Tyr Thr Gly Asn Leu Gly Gly Trp Val Asp Lys Tyr Val Tyr Ser Ser Gly Trp Val Tyr Leu Glu Ala
Pro Ala Tyr Asp Pro Ala Asn Gly Gln Tyr Gly Tyr Ser Val Trp Ser Tyr Cys Gly Val Gly SEQ ID NO.: 49
gtggtttatgacgatgtccgctatgacctttatgccgtaggcatgggccgtgtttatcatgttcacgagctcctgcttggagccaaagcgcgtctct
accgttcccttctggtcgtactcaccgaggtcaaagaagtcgtaggggtcgtagcccatcgaataggcgccgcccatgcccttgctcgccggg
ggaatccatatcgccgaaatcccggcgcttgcccagtcgggtatcttctgggctatcgtgtcccaccagattcctcccatggggacgtcccagta
gaaggcctgcattatgagcccgccctcttcgagcccggaatactttgccataagttacctcctactagtagattaaaattctgtttcctgtgtgaaatt
gtt SEQ ID NO.: 50
Val Val Tyr Asp Asp Val Arg Tyr Asp Leu Tyr Ala Val Gly Met Gly Arg Val Tyr His Val His Glu
Leu Leu Leu Gly Ala Lys Ala Arg Leu Tyr Arg Ser Leu Leu Val Val Leu Thr Glu Val Lys Glu Val
Val Gly Val Val Ala His Arg Ile Gly Ala Ala His Ala Leu Ala Arg Arg Gly Asn Pro Tyr Arg Arg
Asn Pro Gly Ala Cys Pro Val Gly Tyr Leu Leu Gly Tyr Arg Val Pro Pro Asp Ser Ser His Gly Asp
Val Pro Val Glu Gly Leu His Tyr Glu Pro Ala Leu Phe Glu Pro Gly Ile Leu Cys His Lys Leu Pro
Pro Thr Ser Arg Leu Lys Phe Cys Phe Leu Cys Glu Ile Val SEQ ID NO.: 51
ATGGCCAAGTACCTGGAGCTCGAAGAGGGCGGGGTCATAATGCAGGCGTTCTACTGGG
ACGTGCCTTCAGGAGGAATATGGTGGGACACAATACGGCAGAAGATACCGGAGTGGT
ACGATGCCGGAATCTCCGCAATATGGATTCCCCCGGCGAGCAAGGGCATGGGCGGCGC
CTATTCGATGGGCTACGACCCCTACGACTTCTTTGACCTCGGTGAGTACGACCAGAAG
GGAACGGTAGAGACGCGCTTTGGCTCCAAGCAGGAGCTCGTGAACATGATAAACACC
GCCCACGCCTATGGCATGAAGGTAATAGCCGATATAGTCATCAACCACCGCGCCGGCG
GTGACCTGGAGTGGAACCCCTTCGTGAACGACTATACCTGGACCGACTTCTCAAAGGT
CGCGTCGGGTAAATACACGGCCAACTACCTCGACTTCCACCCCAACGAGGTCAAGTGC
TGTGACGAGGGCACATTTGGAGGCTTCCCAGACATAGCCCACGAGAAGAGCTGGGAC
CAGCACTGGCTCTGGGCGAGCGATGAGAGCTACGCCGCCTACCTAAGGAGCATCGGCG
TTGATGCCTGGCGCTTTGACTACGTGAAGGGCTACGGAGCGTGGGTCGTCAAGGACTG
GCTCAACTGGTGGGGCGGCTGGGCCGTTGGCGAGTACTGGGACACCAACGTTGATGCA
CTCCTCAACTGGGCCTACTCGAGCGGCGCCAAGGTCTTCGACTTCCCGCTCTACTACAA
GATGGATGAGGCCTTTGACAACAAAAACATTCCAGCGCTCGTCTCTGCCCTTCAGAAC
GGCCAGACTGTTGTCTCCCGCGACCCGTTCAAGGCCGTAACCTTTGTAGCAAACCACG
ACACCGATATAATCTGGAACAAGTATCCAGCCTACGCGTTCATCCTCACCTACGAGGG
CCAGCCGACAATATTCTACCGCGACTACGAGGAGTGGCTCAACAAGGATAAGCTCAAG
AACCTCATCTGGATACATGACAACCTCGCCGGAGGAAGCACTGACATCGTTTACTACG
ACAACGACGAGCTGATATTCGTGAGAAACGGCTACGGAAGCAAGCCGGGACTGATAA
CATACATCAACCTCGCCTCAAGCAAAGCCGGAAGGTGGGTTTACGTTCCGAAGTTCGC
AGGCTCGTGCATACACGAGTACACCGGCAATCTCGGCGGCTGGGTGGACAAGTGGGTG
GACTCAAGCGGCTGGGTCTACCTCGAGGCTCCTGCCCACGACCCGGCCAACGGCCAGT
ACGGCTACTCCGTCTGGAGCTATTGCGGTGTTGGCTGA SEQ ID NO.: 52
MAKYLELEEGGVIMQAFYWDVPSGGIWWDTIRQKIPEWYDAGISAIWIPPASKGMGGAYS
MGYDPYDFFDLGEYDQKGTVETRFGSKQELVNMINTAHAYGMKVIADIVINHRAGGDLE
WNPFVNDYTWTDFSKVASGKYTANYLDFHPNEVKCCDEGTFGGFPDIAHEKSWDQHWL
WASDESYAAYLRSIGVDAWRFDYVKGYGAWVVKDWLNWWGGWAVGEYWDTNVDAL
LNWAYSSGAKVFDFPLYYKMDEAFDNKNIPALVSALQNGQTVVSRDPFKAVTFVANHDT
DIIWNKYPAYAFILTYEGQPTIFYRDYEEWLNKDKLKNLIWIHDNLAGGSTDIVYYDNDELI
FVRNGYGSKPGLITYINLASSKAGRWVYVPKFAGSCIHEYTGNLGGWVDKWVDSSGWVY
LEAPAHDPANGQYGYSVWSYCGVG SEQ ID NO.: 37
atggccaagtacctggagctcgaagagggcggggtcataatgcaggcgttctactgggacgtgccttcaggaggaatatggtgggacacaat
acggcagaagataccggagtggtacgatgccggaatctccgcaatatggattccccggcgagcaagggcatgggcggcgcctattcgatg
ggctacgacccctacgacttctttgacctcggtgagtacgaccagaagggaacggtagagacgcgctttggctccaagcaggagctcgtgaa
catgataaacaccgcccacgcctatggcatgaaggtaatagccgatatagtcatcaaccaccgcgccggcggtgacctggagtggaacccctt
cgtgaacgactatacctggaccgacttctcaaaggtcgcgtcgggtaaatacacggccaactacctcgacttccaccccaacgagctccatgc
gggcgattccggaacatttggaggctatcccgacatatgccacgacaagagctgggaccagtactggctctgggccagccaggagagctac
gcggcatatctcaggagcatcggcatcgatgcctggcgctttgactacgtgaagggctacggagcgcgggtcgtcaaggactggctcaactg
gtggggcggctgggccgttggcgagtactgggacaccaacgttgatgcactcctcaactgggcctactcgagcggcgccaaggtcttcgactt
cccgctctactacaagatggatgaggcctttgacaacaaaaacattccagcgctcgtctctgcccttcagaacggccagactgttgtctcccgcg
acccgttcaaggccgtaacctttgtagcaaaccacgacaccgatataatctggaacaagtatccagcctacgcgttcatcctcacctacgaggg
ccagccgacaatattctatcgcgactacgaggagtggctcaacaaggataagctcaagaacctcatctggatacatgacaacctcgccggagg
aagcactgacatcgtttactacgacaacgacgagctgatattcgtgagaaacggctacggaagcaagccgggactgataacatacatcaacct
cgcctcaagcaaagccggaaggtgggtttacgttccgaagttcgcaggctcgtgcatacacgagtacaccggcaatctcggcggctgggtgg

Figure 16O acaagtgggtggactcaagcggctgggtctacctcgaggctcctgcccacgacccggccaacggccagtacggctactccgtctggagctac
tgcggggtggggtga SEQ ID NO.: 38
Met Ala Lys Tyr Leu Glu Leu Glu Glu Gly Gly Val Ile Met Gln Ala Phe Tyr Trp Asp Val Pro Ser
Gly Gly Ile Trp Trp Asp Thr Ile Arg Gln Lys Ile Pro Glu Trp Tyr Asp Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Met Lys Val Ile Ala Asp Ile Val Ile Asn His Arg Ala Gly Gly
Asp Leu Glu Trp Asn Pro Phe Val Asn Asp Tyr Thr Trp Thr Asp Phe Ser Lys Val Ala Ser Gly Lys
Tyr Thr Ala Asn Tyr Leu Asp Phe His Pro Asn Glu Leu His Ala Gly Asp Ser Gly Thr Phe Gly Gly
Tyr Pro Asp Ile Cys His Asp Lys Ser Trp Asp Gln Tyr Trp Leu Trp Ala Ser Gln Glu Ser Tyr Ala
Ala Tyr Leu Arg Ser Ile Gly Ile Asp Ala Trp Arg Phe Asp Tyr Val Lys Gly Tyr Gly Ala Arg Val
Val Lys Asp Trp Leu Asn Trp Trp Gly Gly Trp Ala Val Gly Glu Tyr Trp Asp Thr Asn Val Asp Ala
Leu Leu Asn Trp Ala Tyr Ser Ser Gly Ala Lys Val Phe Asp Phe Pro Leu Tyr Tyr Lys Met Asp Glu
Ala Phe Asp Asn Lys Asn Ile Pro Ala Leu Val Ser Ala Leu Gln Asn Gly Gln Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Lys Leu Lys Asn Leu Ile Trp Ile His Asp Asn Leu Ala Gly Gly Ser Thr Asp Ile Val Tyr
Tyr Asp Asn Asp Glu Leu Ile Phe Val Arg Asn Gly Tyr Gly Ser Lys Pro Gly Leu Ile Thr Tyr Ile
Asn Leu Ala Ser Ser Lys Ala Gly Arg Trp Val Tyr Val Pro Lys Phe Ala Gly Ser Cys Ile His Glu
Tyr Thr Gly Asn Leu Gly Gly Trp Val Asp Lys Trp Val Asp Ser Ser Gly Trp Val Tyr Leu Glu Ala
Pro Ala His Asp Pro Ala Asn Gly Gln Tyr Gly Tyr Ser Val Trp Ser Tyr Cys Gly Val Gly SEQ ID NO.: 39
atggccaagtacctggagctcgaagagggcggggtcataatgcaggcgttctactgggacgtgccttcaggaggaatatggtgggacacaat
acggcagaagataccggagtggtacgatgccggaatctccgcaatatggattcctcccgcgagcaggggtatgagcggcggctattcgatgg
gctacgacccctacgattattttgacctcggtgagtactaccagaagggaacggtggaaacgaggttcggctcaaagcaggagctcataaacat
gataaacaccgcccacgccatggcatgaaggtaatagccgatatagtcatcaaccaccgcgccggcggtgacctggagtggaaccccttcgt
gaacgactatacctggaccgacttctcaaaggtcgcgtcgggtaaatacacggccaactacctcgacttccacccgaacgagctccatgcggg
cgattccggaacatttggaggctatcccgacatatgccacgacaagagctgggaccagtactggctctgggccagccaggagagctacgcgg
catatctcaggagcatcggtatcgatgcctggcgctttgactacgtgaagggctacggagcgtgggtcgtcaaggactggctcaactggtggg
gcggctgggccgttggcgagtactggaccccaacgttgatgccctcctcccctgggcctactcgagcggcgccaaggtcttcgacttcccgc
tctactacaagatggatgaggcctttgacaacaaaaacattccagcgctcgtctctgcccttcagaacggccagactgttgtctcccgcgacccg
ttcaaggccgtaacctttgtagccaaccacgataccgatataatctggaacaagtatccagcctacgcgttcatcctcacctacgagggccagcc
gacaatattctaccgcgactacgaggagtggctcaacaaggataagctcaagaacctcatctggatacatgacaacctcgccggaggaagca
ccgacatagtctactacgataacgatgaactcatcttcgtcaggaacggctacggggacaagccggggcttataacctacatcaacctaggctc
gagcaaggccggaaggtgggtctacgttccgaagttcgcgggagcgtgcatccacgagtacaccggcaacctcggcggctgggtggacaa
gtgggtggactcaagcgggtgggtgtacctcgaggcccctgcccacgacccggccaacggctattacggctactccgtctggagctactgcg
gggtgggctga SEQ ID NO.: 40
Met Ala Lys Tyr Leu Glu Leu Glu Glu Gly Gly Val Ile Met Gln Ala Phe Tyr Trp Asp Val Pro Ser
Gly Gly Ile Trp Trp Asp Thr Ile Arg Gln Lys Ile Pro Glu Trp Tyr Asp Ala Gly Ile Ser Ala Ile Trp
Ile Pro Pro Ala Ser Arg Gly Met Ser Gly Gly Tyr Ser Met Gly Tyr Asp Pro Tyr Asp Tyr Phe Asp
Leu Gly Glu Tyr Tyr Gln Lys Gly Thr Val Glu Thr Arg Phe Gly Ser Lys Gln Glu Leu Ile Asn Met
Ile Asn Thr Ala His Ala Tyr Gly Met Lys Val Ile Ala Asp Ile Val Ile Asn His Arg Ala Gly Gly Asp
Leu Glu Trp Asn Pro Phe Val Asn Asp Tyr Thr Trp Thr Asp Phe Ser Lys Val Ala Ser Gly Lys Tyr
Thr Ala Asn Tyr Leu Asp Phe His Pro Asn Glu Leu His Ala Gly Asp Ser Gly Thr Phe Gly Gly Tyr
Pro Asp Ile Cys His Asp Lys Ser Trp Asp Gln Tyr Trp Leu Trp Ala Ser Gln Glu Ser Tyr Ala Ala

Figure 16P

Tyr Leu Arg Ser Ile Gly Ile Asp Ala Trp Arg Phe Asp Tyr Val Lys Gly Tyr Gly Ala Trp Val Val
Lys Asp Trp Leu Asn Trp Trp Gly Gly Trp Ala Val Gly Glu Tyr Trp Asp Pro Asn Val Asp Ala Leu
Leu Pro Trp Ala Tyr Ser Ser Gly Ala Lys Val Phe Asp Phe Pro Leu Tyr Tyr Lys Met Asp Glu Ala
Phe Asp Asn Lys Asn Ile Pro Ala Leu Val Ser Ala Leu Gln Asn Gly Gln Thr Val Val Ser Arg Asp
Pro Phe Lys Ala Val Thr Phe Val Ala Asn His Asp Thr Asp Ile Ile Trp Asn Lys Tyr Pro Ala Tyr
Ala Phe Ile Leu Thr Tyr Glu Gly Gln Pro Thr Ile Phe Tyr Arg Asp Tyr Glu Glu Trp Leu Asn Lys
Asp Lys Leu Lys Asn Leu Ile Trp Ile His Asp Asn Leu Ala Gly Gly Ser Thr Asp Ile Val Tyr Tyr
Asp Asn Asp Glu Leu Ile Phe Val Arg Asn Gly Tyr Gly Asp Lys Pro Gly Leu Ile Thr Tyr Ile Asn
Leu Gly Ser Ser Lys Ala Gly Arg Trp Val Tyr Val Pro Lys Phe Ala Gly Ala Cys Ile His Glu Tyr
Thr Gly Asn Leu Gly Gly Trp Val Asp Lys Trp Val Asp Ser Ser Gly Trp Val Tyr Leu Glu Ala Pro
Ala His Asp Pro Ala Asn Gly Tyr Tyr Gly Tyr Ser Val Trp Ser Tyr Cys Gly Val Gly

SEQ ID NO.: 41
atggccaagtacctggagctcgaagagggcggggtcataatgcaggcgttctactgggacgtgccttcaggaggaatatggtgggacacaat
acggcagaagataccggagtggtacgatgccggaatctccgcaatatggattcctcccgcgagcaagggtatgagcggcggctattcgatgg
gctacgaccccctacgattattttgacctcggtgagtactaccagaagggaacggtggaaacgaggttcggctcaaagcaggagctcataaacat
gataaacacggcccatgcctacggcataaaggtcatagcggacatcgtcataaaccaccgcgcaggcggagacctcgagtggaacccgttc
gttggggactacacctggacggacttctcaaaggtggcctcgggcaaatatactgccaactacctcgacttccacccgaacgagctccatgcg
ggcgattccggaacatttggaggctatcccgacatatgccacgacaagagctgggaccagtactggctctgggccagccaggagagctacgc
ggcatatctcaggagcatcggcatcgatgcctggcgctttgactacgtgaagggctacggagcgtgggtcgtcaaggactggctcaactggtg
gggcggctgggccgttggcgagtactgggacaccaacgttgatgcactcctcaactgggcctactcgagcggcgccaaggtcttcgacttccc
gctctactacaagatggacgcggccttgacaacaagaacattcccgcactcgtcgaggccctcaagaacggggggcacagtcgtcagccgcg
acccgtttaaggccgtaaccttcgttgcaaaccacgacaccgatataatctggaacaagtatccagcctacgcgttcatcctcacctacgagggc
cagccgacaatattctaccgcgactacgaggagtggctcaacaaggataagctcaagaacctcatctggatacatgacaacctcgccggagg
aagcacgagcatagtttactacgacagcgacgagatgatcttcgtgaggaacggctatggaagcaagcctggcctataacttacatcaacctc
ggctcgagcaaggttggaaggtggttatgtgccgaagttcgcgggcgcgtgcatccacgagtatactggtaacctcggaggctgggtagac
aagtacgtctactcaagcggctgggtctatctcgaagctccagcttacgaccctgccaacgggcagtatggctactccgtgtggagctactgcg
gtgttgggtga SEQ ID NO.: 42
Met Ala Lys Tyr Leu Glu Leu Glu Glu Gly Gly Val Ile Met Gln Ala Phe Tyr Trp Asp Val Pro Ser
Gly Gly Ile Trp Trp Asp Thr Ile Arg Gln Lys Ile Pro Glu Trp Tyr Asp Ala Gly Ile Ser Ala Ile Trp
Ile Pro Pro Ala Ser Lys Gly Met Ser Gly Gly Tyr Ser Met Gly Tyr Asp Pro Tyr Asp Tyr Phe Asp
Leu Gly Glu Tyr Tyr Gln Lys Gly Thr Val Glu Thr Arg Phe Gly Ser Lys Gln Glu Leu Ile Asn Met
Ile Asn Thr Ala His Ala Tyr Gly Ile Lys Val Ile Ala Asp Ile Val Ile Asn His Arg Ala Gly Gly Asp
Leu Glu Trp Asn Pro Phe Val Gly Asp Tyr Thr Trp Thr Asp Phe Ser Lys Val Ala Ser Gly Lys Tyr
Thr Ala Asn Tyr Leu Asp Phe His Pro Asn Glu Leu His Ala Gly Asp Ser Gly Thr Phe Gly Gly Tyr
Pro Asp Ile Cys His Asp Lys Ser Trp Asp Gln Tyr Trp Leu Trp Ala Ser Gln Glu Ser Tyr Ala Ala
Tyr Leu Arg Ser Ile Gly Ile Asp Ala Trp Arg Phe Asp Tyr Val Lys Gly Tyr Gly Ala Trp Val Val
Lys Asp Trp Leu Asn Trp Trp Gly Gly Trp Ala Val Gly Glu Tyr Trp Asp Thr Asn Val Asp Ala
Leu Leu Asn Trp Ala Tyr Ser Ser Gly Ala Lys Val Phe Asp Phe Pro Leu Tyr Tyr Lys Met Asp Ala
Ala Phe Asp Asn Lys Asn Ile Pro Ala Leu Val Glu Ala Leu Lys Asn Gly Gly Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Lys Leu Lys Asn Leu Ile Trp Ile His Asp Asn Leu Ala Gly Gly Ser Thr Ser Ile Val Tyr
Tyr Asp Ser Asp Glu Met Ile Phe Val Arg Asn Gly Tyr Gly Ser Lys Pro Gly Leu Ile Thr Tyr Ile
Asn Leu Gly Ser Ser Lys Val Gly Arg Trp Val Tyr Val Pro Lys Phe Ala Gly Ala Cys Ile His Glu
Tyr Thr Gly Asn Leu Gly Gly Trp Val Asp Lys Tyr Val Tyr Ser Ser Gly Trp Val Tyr Leu Glu Ala
Pro Ala Tyr Asp Pro Ala Asn Gly Gln Tyr Gly Tyr Ser Val Trp Ser Tyr Cys Gly Val Gly

Figure 16Q

SEQ ID NO.: 43
atggccaagtactccgagctggaagagggcggcgttataatgcaggccttctactgggacgtcccaggtggaggaatctggtgggacaccat
caggagcaagataccggagtggtacgaggcgggaatatccgccatttggattccccggcgagcaagggcatgggcggcgcctattcgatg
ggctacgaccccctacgacttctttgacctcggtgagtacgaccagaagggaacggtagagacgcgctttggctccaagcaggagctcgtgaa
catgataaacacggcccatgcctacggcataaaggtcatagcggacatcgtcataaaccaccgcgcaggcggagacctcgagtggaacccg
ttcgttggggactacacctggacggacttctcaaaggtggcctcgggcaaatatactgccaactacctcgacttccaccccaacgaggtcaagt
gctgtgacgagggcacatttggaggcttcccagacatagcccacgagaagagctgggaccagcactggctctgggcgagcgatgagagcta
cgccgcctacctaaggagcatcggcgttgatgcctggcgcttcgactacgtcaagggctacggagcgtgggtcgtcaaggactggctggact
ggtggggaggctgggccgtcggggagtactgggacacaaacgttgatgcactgctcaactgggcctactcgagcgatgcaaaagtcttcgac
ttcccgctctactacaagatggatgaggcctttgacaacaaaaacattccagcgctcgtctctgcccttcagaacggccagactgttgtctcccgc
gacccgttcaaggccgtaacctttgtagcaaaccacgacaccgatataatctggaacaagtatccagcctacgcgttcatcctcacctacgagg
gccagccgacaatattctaccgcgactacgaggagtggctcaacaaggataagctcaagaacctcatctggatacatgacaacctcgtcggag
gaagcacgagcatagtttactacgacagcgacgagatgatcttcgtgaggaacggctatggaagcaagcctggccttataacttacatcaacct
cggctcgagcaaggttggaaggtgggtttacgttccgaagttcgcaggctcgtgcatacacgagtacaccggcaatctcggcggctgggtgg
acaagtggtggactcaagcggctgggtctacctcgaggctcctgcccacgacccggccaacggccagtacggctactccgtctggagctac
tgcggtgttggctga SEQ ID NO.: 44
Met Ala Lys Tyr Ser Glu Leu Glu Glu Gly Gly Val Ile Met Gln Ala Phe Tyr Trp Asp Val Pro Gly
Gly Gly Ile Trp Trp Asp Thr Ile Arg Ser Lys Ile Pro Glu Trp Tyr Glu Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly Gly
Asp Leu Glu Trp Asn Pro Phe Val Gly Asp Tyr Thr Trp Thr Asp Phe Ser Lys Val Ala Ser Gly Lys
Tyr Thr Ala Asn Tyr Leu Asp Phe His Pro Asn Glu Val Lys Cys Cys Asp Glu Gly Thr Phe Gly
Gly Phe Pro Asp Ile Ala His Glu Lys Ser Trp Asp Gln His Trp Leu Trp Ala Ser Asp Glu Ser Tyr
Ala Ala Tyr Leu Arg Ser Ile Gly Val Asp Ala Trp Arg Phe Asp Tyr Val Lys Gly Tyr Gly Ala Trp
Val Val Lys Asp Trp Leu Asp Trp Trp Gly Gly Trp Ala Val Gly Glu Tyr Trp Asp Thr Asn Val Asp
Ala Leu Leu Asn Trp Ala Tyr Ser Ser Asp Ala Lys Val Phe Asp Phe Pro Leu Tyr Tyr Lys Met Asp
Glu Ala Phe Asp Asn Lys Asn Ile Pro Ala Leu Val Ser Ala Leu Gln Asn Gly Gln Thr Val Val Ser
Arg Asp Pro Phe Lys Ala Val Thr Phe Val Ala Asn His Asp Thr Asp Ile Ile Trp Asn Lys Tyr Pro
Ala Tyr Ala Phe Ile Leu Thr Tyr Glu Gly Gln Pro Thr Ile Phe Tyr Arg Asp Tyr Glu Glu Trp Leu
Asn Lys Asp Lys Leu Lys Asn Leu Ile Trp Ile His Asp Asn Leu Val Gly Gly Ser Thr Ser Ile Val
Tyr Tyr Asp Ser Asp Glu Met Ile Phe Val Arg Asn Gly Tyr Gly Ser Lys Pro Gly Leu Ile Thr Tyr
Ile Asn Leu Gly Ser Ser Lys Val Gly Arg Trp Val Tyr Val Pro Lys Phe Ala Gly Ser Cys Ile His
Glu Tyr Thr Gly Asn Leu Gly Gly Trp Val Asp Lys Trp Val Asp Ser Ser Gly Trp Val Tyr Leu Glu
Ala Pro Ala His Asp Pro Ala Asn Gly Gln Tyr Gly Tyr Ser Val Trp Ser Tyr Cys Gly Val Gly SEQ ID NO.: 45
atggccaagtactccgacctggaagagggcggcgttataatgcaggccttctactgggacgtcccaggtggaggaatctggtgggacaccat
caggagcaagataccggagtggtacgaggcgggaatatccgccatttggattccccggcgagcaagggcatgggcggcgcctattcgatg
ggctacgaccccctacgacttctttgacctcggtgagtacgaccagaagggaacggtagagacgcgctttggctccaagcaggagctcgtgaa
catgataaacacggcccatgcctacggcataaaggtcatagcggacatcgtcataaaccaccgcgcaggcggagacctcgagtggaacccg
ttcgttggggactacacctggacggacttctcaaaggtggcctcgggcaaatatactgccaactacctcgacttccaccccaacgaggtcaagt
gctgtgacgagggcacatttggaggcttcccagacatagcccacgagaagagctgggaccagcactggctctgggcgagcgatgagagcta
cgccgcctacctaaggagcatcggcgttgatgcctggcgctttgactacgtgaagggctacggagcgtgggtcgtcaaggactggctcaactg
gtggggcggctgggccgttggcgagtactgggacaccaacgttgatgcactcctcaactgggcctactcgagcggcgccaaggtcttcgactt
cccgctctactacaagatggatgaggcctttgacaacaaaaacattccagcgctcgtctctgcccttcagaacggccagactgttgtctcccgcg
acccgttcaaggccgtaacctttgtagcaaaccacgacaccgatataatctggaacaagtatccagcctacgcgttcatcctcacctacgaggg
ccagccgacaatattctaccgcgactacgaggagtggctcaacaaggataagctcaagaacctcatctggatacatgacaacctcgccggag

Figure 16R gaagcaccgacatagtctactacgataacgatgaactcatcttcgtcaggaacggctacggggacaagccggggcttataacctacatcaacct
aggctcgagcaaggccggaaggtggggttatgtgccgaagttcgcgggcgcgtgcatccacgagtatactggtaacctcggaggctgggtag
acaagtacgtctactcaagcggctgggtctatctcgaagctccagcttacgaccctgccaacgggcagtatggctactccgtgtggagctattgc
ggtgttgggtga SEQ ID NO.: 46
Met Ala Lys Tyr Ser Asp Leu Glu Glu Gly Gly Val Ile Met Gln Ala Phe Tyr Trp Asp Val Pro Gly
Gly Gly Ile Trp Trp Asp Thr Ile Arg Ser Lys Ile Pro Glu Trp Tyr Glu Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly Gly
Asp Leu Glu Trp Asn Pro Phe Val Gly Asp Tyr Thr Trp Thr Asp Phe Ser Lys Val Ala Ser Gly Lys
Tyr Thr Ala Asn Tyr Leu Asp Phe His Pro Asn Glu Val Lys Cys Cys Asp Glu Gly Thr Phe Gly
Gly Phe Pro Asp Ile Ala His Glu Lys Ser Trp Asp Gln His Trp Leu Trp Ala Ser Asp Glu Ser Tyr
Ala Ala Tyr Leu Arg Ser Ile Gly Val Asp Ala Trp Arg Phe Asp Tyr Val Lys Gly Tyr Gly Ala Trp
Val Val Lys Asp Trp Leu Asn Trp Trp Gly Gly Trp Ala Val Gly Glu Tyr Trp Asp Thr Asn Val Asp
Ala Leu Leu Asn Trp Ala Tyr Ser Ser Gly Ala Lys Val Phe Asp Phe Pro Leu Tyr Tyr Lys Met Asp
Glu Ala Phe Asp Asn Lys Asn Ile Pro Ala Leu Val Ser Ala Leu Gln Asn Gly Gln Thr Val Val Ser
Arg Asp Pro Phe Lys Ala Val Thr Phe Val Ala Asn His Asp Thr Asp Ile Ile Trp Asn Lys Tyr Pro
Ala Tyr Ala Phe Ile Leu Thr Tyr Glu Gly Gln Pro Thr Ile Phe Tyr Arg Asp Tyr Glu Glu Trp Leu
Asn Lys Asp Lys Leu Lys Asn Leu Ile Trp Ile His Asp Asn Leu Ala Gly Gly Ser Thr Asp Ile Val
Tyr Tyr Asp Asn Asp Glu Leu Ile Phe Val Arg Asn Gly Tyr Gly Asp Lys Pro Gly Leu Ile Thr Tyr
Ile Asn Leu Gly Ser Ser Lys Ala Gly Arg Trp Val Tyr Val Pro Lys Phe Ala Gly Ala Cys Ile His
Glu Tyr Thr Gly Asn Leu Gly Gly Trp Val Asp Lys Tyr Val Tyr Ser Ser Gly Trp Val Tyr Leu Glu
Ala Pro Ala Tyr Asp Pro Ala Asn Gly Gln Tyr Gly Tyr Ser Val Trp Ser Tyr Cys Gly Val Gly SEQ ID NO.: 47
atggccaagtacaccgagctggaagagggcggcgttataatgcaggccttctactgggacgtcccaggtggaggaatctggtgggacaccat
caggagcaagataccggagtggtacgaggcgggaatatccgccatttggattcccccggcgagcaagggcatgggcggcgcctattcgatg
ggctacgacccctacgacttctttgacctcggtgagtacgaccagaaagggaacggtagagacgcgcttggctccaagcaggagctcgtgaa
catgataaacaccgcccacgcctatggcatgaaggtaatagccgatatagtcatcaaccaccgcgccggcggtgacctggagtggaacccctt
cgtgaacgactatacctggaccgacttctcaaaggtcgcgtcgggtaaatacacggccaactacctcgacttccaccccaacgaggtcaagtg
ctgtgacgagggcacatttggaggcttccagacatagcccacgagaagagctgggaccagcactggctctgggcgagcgatgagagctac
gccgcctacctaaggagcatcggcgttgatgcctggcgctttgactacgtgaagggctacggagcgtgggtcgtcaaggactggctcaactgg
tggggcggttgggccgttggcgagtactgggacaccaacgttgatgcactcctcaactgggcctactcgagcggcgccaaggtcttcgacttc
ccgctctactacaagatggatgaggcctttgacaacaaaaacattccagcgctcgtctctgcccttcagaacggccagactgttgtctcccgcga
cccgttcaaggccgtaacctttgtagcaaaccacgacaccgatataatctggaacaagtaccttgcttatgctttcatcctcacctacgaaggcca
gcccgtcatattctaccgcgactacgaggagtggctcaacaaggacaggttgaacaacctcatatggatacacgaccacctcgcaggtggaag
cacgagcatagtttactacgacagcgacgagatgatcttcgtgaggaacggctatggaagcaagcctggccttataacttacatcaacctcggct
cgagcaaggttggaaggtgggtttacgttccgaagttcgcaggcccgtgcatacacgagtacaccggcaatctcggcggctgggtggacaag
tgggtggactcaagcggctgggtctacctcgaggctcctgcccacgacccggccaacggccagtacggctactccgtctggagctactgcgg
tgttgggtag SEQ ID NO.: 48
Met Ala Lys Tyr Thr Glu Leu Glu Glu Gly Gly Val Ile Met Gln Ala Phe Tyr Trp Asp Val Pro Gly
Gly Gly Ile Trp Trp Asp Thr Ile Arg Ser Lys Ile Pro Glu Trp Tyr Glu Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Met Lys Val Ile Ala Asp Ile Val Ile Asn His Arg Ala Gly Gly
Asp Leu Glu Trp Asn Pro Phe Val Asn Asp Tyr Thr Trp Thr Asp Phe Ser Lys Val Ala Ser Gly Lys

Figure 16S

Tyr Thr Ala Asn Tyr Leu Asp Phe His Pro Asn Glu Val Lys Cys Cys Asp Glu Gly Thr Phe Gly
Gly Phe Pro Asp Ile Ala His Glu Lys Ser Trp Asp Gln His Trp Leu Trp Ala Ser Asp Glu Ser Tyr
Ala Ala Tyr Leu Arg Ser Ile Gly Val Asp Ala Trp Arg Phe Asp Tyr Val Lys Gly Tyr Gly Ala Trp
Val Val Lys Asp Trp Leu Asn Trp Trp Gly Gly Trp Ala Val Gly Glu Tyr Trp Asp Thr Asn Val Asp
Ala Leu Leu Asn Trp Ala Tyr Ser Ser Gly Ala Lys Val Phe Asp Phe Pro Leu Tyr Tyr Lys Met Asp
Glu Ala Phe Asp Asn Lys Asn Ile Pro Ala Leu Val Ser Ala Leu Gln Asn Gly Gln Thr Val Val Ser
Arg Asp Pro Phe Lys Ala Val Thr Phe Val Ala Asn His Asp Thr Asp Ile Ile Trp Asn Lys Tyr Leu
Ala Tyr Ala Phe Ile Leu Thr Tyr Glu Gly Gln Pro Val Ile Phe Tyr Arg Asp Tyr Glu Glu Trp Leu
Asn Lys Asp Arg Leu Asn Asn Leu Ile Trp Ile His Asp His Leu Ala Gly Gly Ser Thr Asp Ile Val
Tyr Tyr Asp Ser Asp Glu Met Ile Phe Val Arg Asn Gly Tyr Gly Ser Lys Pro Gly Leu Ile Thr Tyr
Ile Asn Leu Gly Ser Ser Lys Val Gly Arg Trp Val Tyr Val Pro Lys Phe Ala Gly Pro Cys Ile His
Glu Tyr Thr Gly Asn Leu Gly Gly Trp Val Asp Lys Trp Val Asp Ser Ser Gly Trp Val Tyr Leu Glu
Ala Pro Ala His Asp Pro Ala Asn Gly Gln Tyr Gly Tyr Ser Val Trp Ser Tyr Cys Gly Val Gly

SEQ ID NO.: 53
ATGGCCAAGTACTCCGAGCTGGAAGAGGGCGGCGTTATAATGCAGGCCTTCTACTGGG
ACGTCCCAGGTGGAGGAATCTGGTGGGACACCATCAGGAGCAAGATACCGGAGTGGT
ACGAGGCGGGAATATCCGCCATTTGGATTCCCCGGCGAGCAAGGGCATGGGCGGCG
CCTATTCGATGGGCTACGACCCCTACGACTTCTTTGACCTCGGTGAGTACGACCAGAA
GGGAACGGTAGAGACGCGCTTTGGCTCCAAGCAGGAGCTCGTGAACATGATAAACAC
GGCCCATGCCTACGGCATAAAGGTCATAGCGGACATCGTCATAAACCACCGCACAGGC
GGAGACCTCGAGTGGAACCCGTTCGTTGGGGACTACACCTGGACGGACTTCTCAAAGG
TGGCCTCGGGCAAATATACTGCCAACTACCTCGACTTCCACCCCAACGAGGTCAAGTG
CTGTGACGAGGGCACATTTGGAGGCTTCCCAGACATAGCCCACGAGAAGAGCTGGGA
CCAGCACTGGCTCTGGGCGAGCGATGAGAGCTACGCCGCCTACCTAAGGAGCATCGGC
GTTGATGCCTGGCGCTTCGACTACGTCAAGGGCTACGGAGCGTGGGTCGTCAAGGACT
GGCTGGACTGGTGGGGAGGCTGGGCCGTCGGGGAGTACTGGGACACAAACGTTGATG
CACTGCTCAACTGGGCCTACTCGAGCGATGCAAAAGTCTTCGACTTCCCGCTCTACTAC
AAGATGGATGAGGCCTTTGACAACAAAAACATTCCAGCGCTCGTCTCTGCCCTTCAGA
ACGGCCAGACTGTTGTCTCCCGCGACCCGTTCAAGGCCGTAACCTTTGTAGCAAACCA
CGACACCGATATAATCTGGAACAAGTATCCAGCCTACGCGTTCATCCTCACCTACGAG
GGCCAGCCGACAATATTCTACCGCGACTACGAGGAGTGGCTCAACAAGGATAAGCTCA
AGAACCTCATCTGGATACATGACAACCTCGCCGGAGGAAGCACTGACATCGTTTACTA
CGACAACGACGAGCTGATATTCGTGAGAAACGGCTACGGAAGCAAGCCGGGACTGAT
AACATACATCAACCTCGCCTCAAGCAAAGCCGGAAGGTGGGTCTACGTTCCGAAGTTC
GCGGGAGCGTGCATCCACGAGTACACCGGCAACCTCGGCGGCTGGGTGGACAAGTGG
GTGGACTCAAGCGGGTGGGTGTACCTCGAGGCCCCTGCCCACGACCCGGCCAACGGCT
ATTACGGCTACTCCGTCTGGAGCTACTGCGGTGTTGGCTGA

SEQ ID NO.: 54
MAKYSELEEGGVIMQAFYWDVPGGGIWWDTIRSKIPEWYEAGISAIWIPPASKGMGGAYS
MGYDPYDFFDLGEYDQKGTVETRFGSKQELVNMINTAHAYGIKVIADIVINHRTGGDLEW
NPFVGDYTWTDFSKVASGKYTANYLDFHPNEVKCCDEGTFGGFPDIAHEKSWDQHWLW
ASDESYAAYLRSIGVDAWRFDYVKGYGAWVVKDWLDWWGGWAVGEYWDTNVDALL
NWAYSSDAKVFDFPLYYKMDEAFDNKNIPALVSALQNGQTVVSRDPFKAVTFVANHDTD
IIWNKYPAYAFILTYEGQPTIFYRDYEEWLNKDKLKNLIWIHDNLAGGSTDIVYYDNDELIF
VRNGYGSKPGLITYINLASSKAGRWVYVPKFAGACIHEYTGNLGGWVDKWVDSSGWVY
LEAPAHDPANGYYGYSVWSYCGVG

SEQ ID NO.: 55

Figure 16T

ATGGCCAAGTACCTGGAGCTCGAGGAGGGCGGGGTCATAATGCAGGCGTTCTACTGGG
ACGTGCCTTCAGGAGGAATATGGTGGGACACAATACGGCAGAAGATACCGGAGTGGT
ACGATGCCGGAATCTCCGCAATATGGATTCCCCCGGCGAGCAAGGGCATGGGCGGCGC
CTATTCGATGGGCTACGACCCCTACGACTTCTTTGACCTCGGTGAGTACGACCAGAAG
GGAACGGTAGAGACGCGCTTTGGCTCCAAGCAGGAGCTCGTGAACATGATAAACACC
GCCCACGCCTATGGCATGAAGGTAATAGCCGATATAGTCATCAACCACCGCGCCGGCG
GTGACCTGGAGTGGAACCCCTTCGTGAACGACTATACCTGGACCGACTTCTCAAAGGT
CGCGTCGGGTAAATACACGGCCAACTACCTCGACTTCCACCCGAACGAGCTCCATGCG
GGCGATTCCGGAACATTTGGAGGCTATCCCGACATATGCCACGACAAGAGCTGGGACC
AGTACTGGCTCTGGGCCAGCCAGGAGAGCTACGCGGCATATCTCAGGAGCATCGGCAT
CGATGCCTGGCGCTTTGACTACGTGAAGGGCTACGGAGCGTGGGTCGTCAAGGACTGG
CTCAACTGGTGGGGCGGCTGGGCCGTTGGCGAGTACTGGGACACCAACGTTGATGCAC
TCCTCAACTGGGCCTACTCGAGCGGCGCCAAGGTCTTCGACTTCCCGCTCTACTACAAG
ATGGATGAGGCCTTTGACAACAAAAACATTCCAGCGCTCGTCTCTGCCCTTCAGAACG
GCCAGACTGTTGTCTCCCGCGACCCGTTCAAGGCCGTAACCTTTGTAGCAAACCACGA
CACCGATATAATCTGGAACAAGTACCTTGCTTATGCTTTCATCCTCACCTACGAAGGCC
AGCCCGTCATATTCTACCGCGACTACGAGGAGTGGCTCAACAAGGACAGGTTGAACAA
CCTCATATGGATACACGACCACCTCGCAGGTGGAAGCACGAGCATAGTTTACTACGAC
AGCGACGAGATGATCTTCGTGAGGAACGGCTATGGAAGCAAGCCTGGCCTTATAACTT
ACATCAACCTCGGCTCGAGCAAGGTTGGAAGGTGGGTTTACGTTCCGAAGTTCGCAGG
CTCGTGCATACACGAGTACACCGGCAATCTCGGCGGCTGGGTGGACAAGTGGGTGGAC
TCAAGCGGCTGGGTCTACCTCGAGGCTCCTGCCCACGACCCGGCCAACGGCCAGTACG
GCTACTCCGTCTGGAGCTATTGCGGTGTTGGCTGA

SEQ ID NO.: 56
MAKYLELEEGGVIMQAFYWDVPSGGIWWDTIRQKIPEWYDAGISAIWIPPASKGMGGAYS
MGYDPYDFFDLGEYDQKGTVETRFGSKQELVNMINTAHAYGMKVIADIVINHRAGGDLE
WNPFVNDYTWTDFSKVASGKYTANYLDFHPNELHAGDSGTFGGYPDICHDKSWDQYWL
WASQESYAAYLRSIGIDAWRFDYVKGYGAWVVKDWLNWWGGWAVGEYWDTNVDALL
NWAYSSGAKVFDFPLYYKMDEAFDNKNIPALVSALQNGQTVVSRDPFKAVTFVANHDTD
IIWNKYLAYAFILTYEGQPVIFYRDYEEWLNKDRLNNLIWIHDHLAGGSTSIVYYDSDEMIF
VRNGYGSKPGLITYINLGSSKVGRWVYVPKFAGSCIHEYTGNLGGWVDKWVDSSGWVYL
EAPAHDPANGQYGYSVWSYCGVG

SEQ ID NO.: 57
ATGGCCAAGTACCTGGAGCTCGAAGAGAGCGGGGTCATAATGCAGGCGTTCTACTGGG
ACGTGCCTTCAGGAGGAATATGGTGGGACACAATACGGCAGAAGATACCGGAGTGGT
ACGATGCCGGAATCTCCGCAATATGGATTCCTCCCGCGAGCAAGGGTATGAGCGGCGG
CTATTCGATGGGCTACGACCCCTACGATTATTTTGACCTCGGTGAGTACTACCAGAAGG
GAACGGTGGAAACGAGGTTCGGCTCAAAGCAGGAGCTCATAAACATGATAAACACCG
CCCACGCCTACGGCATCAAGGTCATCGCAGACATAGTAATCAACCACCGCGCCGGAGG
AGACCTTGAGTGGAACCCCTTCGTCAATGACTACACCTGGACGGACTTCTCGAAGGTC
GCTTCCGGCAAGTACACGGCCAACTACCTCGACTTCCACCCCAACGAGGTCAAGTGCT
GTGACGAGGGCACATTTGGAGGCTTCCCAGACATAGCCCACGAGAAGAGCTGGGACC
AGCACTGGCTCTGGGCGAGCGATGAGAGCTACGCCGCCTACCTAAGGAGCATCGGCGT
TGATGCCTGGCGCTTTGACTACGTGAAGGGCTACGGAGCGTGGGTCGTCAAGGACTGG
CTCAACTGGTGGGGTGGCTGGGCCGTCGGGGAGTACTGGGACACAAACGTTGATGCAC
TGCTCAACTGGGCCTACTCGAGCGATGCAAAAGTCTTCGACTTCCCGCTCTACTACAAG
ATGGACGAGGCCTTCGATAACAACAACATTCCCGCCCTGGTGGACGCCCTCAGATACG
GTCAGACAGTGGTCAGCCGCGACCCGTTCAAGGCTGTGACGTTTGTAGCCAACCACGA

TACCGATATAATCTGGAACAAGTACCTTGCTTATGCTTTCATCCTCACCTACGAAGGCC
AGCCCGTCATATTCTACCGCGACTACGAGGAGTGGCTCAACAAGGACAGGTTGAACAA
CCTCATATGGATACACGACCACCTCGCAGGTGGAAGCACTGACATCGTTTACTACGAC
AACGACGAGCTGATATTCGTGAGAAACGGCTACGGAAGCAAGCCGGGACTGATAACA
TACATCAACCTCGCCTCAAGCAAAGCCGGAAGGTGGGTCTACGTTCCGAAGTTCGCGG
GAGCGTGCATCCACGAGTACACCGGCAACCTCGGCGGCTGGGTGGACAAGTGGGTGG
ACTCAAGCGGGTGGGTGTACCTCGAGGCCCCTGCCCACGACCCGGCCAACGGCTATTA
CGGCTACTCCGTCTGGAGCTATTGCGGTGTTGGCTGA

SEQ ID NO.: 58
MAKYLELEESGVIMQAFYWDVPSGGIWWDTIRQKIPEWYDAGISAIWIPPASKGMSGGYS
MGYDPYDYFDLGEYYQKGTVETRFGSKQELINMINTAHAYGIKVIADIVINHRAGGDLEW
NPFVNDYTWTDFSKVASGKYTANYLDFHPNEVKCCDEGTFGGFPDIAHEKSWDQHWLW
ASDESYAAYLRSIGVDAWRFDYVKGYGAWVVKDWLNWWGGWAVGEYWDTNVDALL
NWAYSSDAKVFDFPLYYKMDEAFDNNNIPALVDALRYGQTVVSRDPFKAVTFVANHDTD
IIWNKYLAYAFILTYEGQPVIFYRDYEEWLNKDRLNNLIWIHDHLAGGSTDIVYYDNDELIF
VRNGYGSKPGLITYINLASSKAGRWVYVPKFAGACIHEYTGNLGGWVDKWVDSSGWVY
LEAPAHDPANGYYGYSVWSYCGVG

SEQ ID NO.: 59
atggccaagtacctggagctcgaagagggcggggtcataatgcaggcgttctactgggacgtgccttcaggaggaatatggtgggacacaat
acggcagaagataccggagtggtacgatgccggaatctccgcaatatggattcctcccgcgagcaagggtatgagcggcggctattcgatgg
gctacgaccectacgattattttgacctcggtgagtactaccagaagggaacggtggaaacgaggttcggctcaaagcaggagctcataaacat
gataaacaccgcccacgcctacggcatcaaggtcatcgcagacatagtaatcaaccaccgcgccggaggagaccttgagtggaaccccttcg
tcaatgactacacctggacggacttctcgaaggtcgcttccggcaagtacacggccaactacctcgacttccacccgaacgagctccatgcgg
gcgattccggaacatttggaggctatcccgacatatgccacgacaagagctgggaccagtactggctctgggccagccaggagagctacgcg
gcatatctcaggagcatcggcatcgatgcctggcgcttcgactacgtcaagggctatgctccctgggtcgtcaaggactggctgaactggtggg
gaggctgggcggttggagagtactgggacaccaacgtcgacgctgttctcaactgggcatactcgagcggtgccaaggtctttgacttcgccct
ctactacaagatggacgaggccttcgataacaacaacattcccgccctggtggacgccctcagatacggtcagacagtggtcagccgcgacc
cgttcaaggctgtgacgtttgtagccaaccacgataccgatataatttggaacaagtacccggcctacgccttcatcctcacctacgagggccag
ccgacgatattctaccgcgactacgaggagtggctcaacaaggacaggctcaagaacctcatctggatacacgaccacctcgccggtggaag
cactgacatcgtttactacgacaacgacgagctgatattcgtgagaaacggctacggaagcaagccgggactgataacatacatcaacctcgc
gtcaagcaaagccggaaggtgggtttatgtgccgaagttcgcgggcgcgtgcatccacgagtatactggtaacctcggaggctgggtagaca
agtacgtctactcaagcggctgggtctatctcgaagctccagcttacgaccctgccaacgggcagtatggctactccgtgtggagctattgcggt
gttgggtga SEQ ID NO.: 60
Met Ala Lys Tyr Leu Glu Leu Glu Glu Gly Gly Val Ile Met Gln Ala Phe Tyr Trp Asp Val Pro Ser
Gly Gly Ile Trp Trp Asp Thr Ile Arg Gln Lys Ile Pro Glu Trp Tyr Asp Ala Gly Ile Ser Ala Ile Trp
Ile Pro Pro Ala Ser Lys Gly Met Ser Gly Gly Tyr Ser Met Gly Tyr Asp Pro Tyr Asp Tyr Phe Asp
Leu Gly Glu Tyr Tyr Gln Lys Gly Thr Val Glu Thr Arg Phe Gly Ser Lys Gln Glu Leu Ile Asn Met
Ile Asn Thr Ala His Ala Tyr Gly Ile Lys Val Ile Ala Asp Ile Val Ile Asn His Arg Ala Gly Gly Asp
Leu Glu Trp Asn Pro Phe Val Asn Asp Tyr Thr Trp Thr Asp Phe Ser Lys Val Ala Ser Gly Lys Tyr
Thr Ala Asn Tyr Leu Asp Phe His Pro Asn Glu Leu His Ala Gly Asp Ser Gly Thr Phe Gly Gly Tyr
Pro Asp Ile Cys His Asp Lys Ser Trp Asp Gln Tyr Trp Leu Trp Ala Ser Gln Glu Ser Tyr Ala Ala
Tyr Leu Arg Ser Ile Gly Ile Asp Ala Trp Arg Phe Asp Tyr Val Lys Gly Tyr Ala Pro Trp Val Val
Lys Asp Trp Leu Asn Trp Trp Gly Gly Trp Ala Val Gly Glu Tyr Trp Asp Thr Asn Val Asp Ala Val
Leu Asn Trp Ala Tyr Ser Ser Gly Ala Lys Val Phe Asp Phe Ala Leu Tyr Tyr Lys Met Asp Glu Ala
Phe Asp Asn Asn Ile Pro Ala Leu Val Asp Ala Leu Arg Tyr Gly Gln Thr Val Val Ser Arg Asp
Pro Phe Lys Ala Val Thr Phe Val Ala Asn His Asp Thr Asp Ile Ile Trp Asn Lys Tyr Pro Ala Tyr

Figure 16V

Ala Phe Ile Leu Thr Tyr Glu Gly Gln Pro Thr Ile Phe Tyr Arg Asp Tyr Glu Glu Trp Leu Asn Lys
Asp Arg Leu Lys Asn Leu Ile Trp Ile His Asp His Leu Ala Gly Gly Ser Thr Asp Ile Val Tyr Tyr
Asp Asn Asp Glu Leu Ile Phe Val Arg Asn Gly Tyr Gly Ser Lys Pro Gly Leu Ile Thr Tyr Ile Asn
Leu Ala Ser Ser Lys Ala Gly Arg Trp Val Tyr Val Pro Lys Phe Ala Gly Ala Cys Ile His Glu Tyr
Thr Gly Asn Leu Gly Gly Trp Val Asp Lys Tyr Val Tyr Ser Ser Gly Trp Val Tyr Leu Glu Ala Pro
Ala Tyr Asp Pro Ala Asn Gly Gln Tyr Gly Tyr Ser Val Trp Ser Tyr Cys Gly Val Gly

SEQ ID NO.: 61
atggccaagtactccgagctgaaaaagggcggggtcataatgcaggcgttctactgggacgtgccttcaggaggaatatggtgggacacaat
acggcagaagataccggagtggtacgaggcgggaatatccgccatttggattcctcccgcgagcaagggtatgagcggcggctattcgatgg
gctacgaccccctacgattattttgacctcggtgagtactaccagaagggaacggtggaaacgaggttcggctcaaagcaggagctcataaacat
gataaacaccgccacgcctacggcatcaaggtcatcgcagacatagtaatcaaccaccgcgccggaggagaccttgagtggaaccccttcg
tcaatgactacacctggacggacttctcgaaggtcgcttccggcaagtacacggccaactacctcaacttccacccgaacgagctccatgcgg
gcgattccggaacatttggaggctatcccgacatatgccacgacaagagctgggaccagtactggctctgggccagccaggagagctacgcg
gcatatctcaggagcatcggcatcgatgcctggcgcttcgactacgtcaagggctacggagcgtgggtcgtcaaggactggctggactggtg
ggggaggctgggccgtcggggagtactgggacacaaacgttgatgcactgctcaactgggcctactcgagcgatgcaaaagtcttcgacttccc
gctctactacaagatggatgaggcctttgacaacaaaaacattccagcgctcgtctctgcccttcagaacggccagactgttgtctcccgcgacc
cgttcaaggccgtaacctttgtagcaaaccatgacaccgatataatctggaacaagtatccagcctacgcgttcatcctcacctacgagggccag
ccgacaatattctaccgcgactacgaggagtggctcaacaaggataagctcaagaacctcatctggatacatgacaacctcgccggaggaag
caccgacatagtctactacgataacgatgaactcatcttcgtcaggaacggctacggggacaagccggggcttataacctacatcaacctaggc
tcgagcaaggccggaaggtgggtctacgttccgaagttcgcgggagcgtgcatccacgagtacaccggcaacctcggcggctgggtggaca
agtgggtggactcaagcgggtgggtgtacctcgaggcccctgcccacgacccggccaacggctattacggctactccgtctggagctactgc
ggggtgggctga SEQ ID NO.: 62
Met Ala Lys Tyr Ser Glu Leu Lys Lys Gly Gly Val Ile Met Gln Ala Phe Tyr Trp Asp Val Pro Ser
Gly Gly Ile Trp Trp Asp Thr Ile Arg Gln Lys Ile Pro Glu Trp Tyr Glu Ala Gly Ile Ser Ala Ile Trp
Ile Pro Pro Ala Ser Lys Gly Met Ser Gly Gly Tyr Ser Met Gly Tyr Asp Pro Tyr Asp Tyr Phe Asp
Leu Gly Glu Tyr Tyr Gln Lys Gly Thr Val Glu Thr Arg Phe Gly Ser Lys Gln Glu Leu Ile Asn Met
Ile Asn Thr Ala His Ala Tyr Gly Ile Lys Val Ile Ala Asp Ile Val Ile Asn His Arg Ala Gly Gly Asp
Leu Glu Trp Asn Pro Phe Val Asn Asp Tyr Thr Trp Thr Asp Phe Ser Lys Val Ala Ser Gly Lys Tyr
Thr Ala Asn Tyr Leu Asn Phe His Pro Asn Glu Leu His Ala Gly Asp Ser Gly Thr Phe Gly Gly Tyr
Pro Asp Ile Cys His Asp Lys Ser Trp Asp Gln Tyr Trp Leu Trp Ala Ser Gln Glu Ser Tyr Ala Ala
Tyr Leu Arg Ser Ile Gly Ile Asp Ala Trp Arg Phe Asp Tyr Val Lys Gly Tyr Gly Ala Trp Val Val
Lys Asp Trp Leu Asp Trp Trp Gly Gly Trp Ala Val Gly Glu Tyr Trp Asp Thr Asn Val Asp Ala
Leu Leu Asn Trp Ala Tyr Ser Ser Asp Ala Lys Val Phe Asp Phe Pro Leu Tyr Tyr Lys Met Asp Glu
Ala Phe Asp Asn Lys Asn Ile Pro Ala Leu Val Ser Ala Leu Gln Asn Gly Gln Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Lys Leu Lys Asn Leu Ile Trp Ile His Asp Asn Leu Ala Gly Gly Ser Thr Asp Ile Val Tyr
Tyr Asp Asn Asp Glu Leu Ile Phe Val Arg Asn Gly Tyr Gly Asp Lys Pro Gly Leu Ile Thr Tyr Ile
Asn Leu Gly Ser Ser Lys Ala Gly Arg Trp Val Tyr Val Pro Lys Phe Ala Gly Ala Cys Ile His Glu
Tyr Thr Gly Asn Leu Gly Gly Trp Val Asp Lys Trp Val Asp Ser Ser Gly Trp Val Tyr Leu Glu Ala
Pro Ala His Asp Pro Ala Asn Gly Tyr Tyr Gly Tyr Ser Val Trp Ser Tyr Cys Gly Val Gly SEQ ID NO.: 63
atggccaagtacctggagctcgaagagggcggggtcataatgcaggcgttctactgggacgtgccttcaggaggaatatggtgggacacaat
acggcagaagataccggagtggtacgatgccggaatctccgcaatatggattcccccggcgagcaagggcatgggcggcgcctattcgatg
ggctacgaccccctacgacttctttgacctcggtgagtacgaccagaagggaacggtagagacgcgctttggctccaagcaggagctcgtgaa
catgataaacacggcccatgcctacggcataaaggccatagcggacatcgtcataaaccaccgcgcaggcggagacctcgagtggaaccccg

Figure 16W ttcgttggggactacacctggacggacttctcaaaggtggcctcgggcaaatatactgccaactacctcgacttccaccccaacgaggtcaagt
gctgtgacgagggcacatttggaggcttcccagacatagcccacgagaagagctgggaccagcactggctctgggcgagcgatgagagcta
cgccgcctacctaaggagcatcggcgttgatgcctggcgctttgactacgtgaagggctacggagcgtgggtcgtcaaggactggctcaactg
gtggggcggctgggccgttggcgagtactgggacaccaacgttgatgcactcctcaactgggcctactcgagcggcgccaaggtcttcgactt
cccgctctactacaagatggacgcggcctttgacaacaagaacattcccgcactcgtcgaggccctcaagaacgggggcacagtcgtcagcc
gcgacccgtttaaggccgtaaccttcgttgcaaaccacgacaccgatataatctggaacaagtatccagcctacgcgttcatcctcacctacgag
ggccagccgacaatattctaccgcgactacgaggagtggctcaacaaggataagctcaagaacctcatctggatacatgacaacctcgccgg
aggaagcaccgacatagtctactacgataacgatgaactcatcttcgtcaggaacggctacggggacaagccgggggcttataacctacatcaa
cctaggctggagcaaggccggaaggtgggtttatgtgccgaagttcgcgggcgcgtgcatccacgagtatactggtaacctcggaggctggg
tagacaagtacgtctactcaagcggctgggtctatctcgaagctccagcttacgaccctgccaacgggcagtatggctactccgtgtggagcta
ctgcggggtggggtga SEQ ID NO.: 64
Met Ala Lys Tyr Leu Glu Leu Glu Glu Gly Gly Val Ile Met Gln Ala Phe Tyr Trp Asp Val Pro Ser
Gly Gly Ile Trp Trp Asp Thr Ile Arg Gln Lys Ile Pro Glu Trp Tyr Asp Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Ala Ile Ala Asp Ile Val Ile Asn His Arg Ala Gly Gly
Asp Leu Glu Trp Asn Pro Phe Val Gly Asp Tyr Thr Trp Thr Asp Phe Ser Lys Val Ala Ser Gly Lys
Tyr Thr Ala Asn Tyr Leu Asp Phe His Pro Asn Glu Val Lys Cys Cys Asp Glu Gly Thr Phe Gly
Gly Phe Pro Asp Ile Ala His Glu Lys Ser Trp Asp Gln His Trp Leu Trp Ala Ser Asp Glu Ser Tyr
Ala Ala Tyr Leu Arg Ser Ile Gly Val Asp Ala Trp Arg Phe Asp Tyr Val Lys Gly Tyr Gly Ala Trp
Val Val Lys Asp Trp Leu Asn Trp Trp Gly Gly Trp Ala Val Gly Glu Tyr Trp Asp Thr Asn Val Asp
Ala Leu Leu Asn Trp Ala Tyr Ser Ser Gly Ala Lys Val Phe Asp Phe Pro Leu Tyr Tyr Lys Met Asp
Ala Ala Phe Asp Asn Lys Asn Ile Pro Ala Leu Val Glu Ala Leu Lys Asn Gly Gly Thr Val Val Ser
Arg Asp Pro Phe Lys Ala Val Thr Phe Val Ala Asn His Asp Thr Asp Ile Ile Trp Asn Lys Tyr Pro
Ala Tyr Ala Phe Ile Leu Thr Tyr Glu Gly Gln Pro Thr Ile Phe Tyr Arg Asp Tyr Glu Glu Trp Leu
Asn Lys Asp Lys Leu Lys Asn Leu Ile Trp Ile His Asp Asn Leu Ala Gly Gly Ser Thr Asp Ile Val
Tyr Tyr Asp Asn Asp Glu Leu Ile Phe Val Arg Asn Gly Tyr Gly Asp Lys Pro Gly Leu Ile Thr Tyr
Ile Asn Leu Gly Trp Ser Lys Ala Gly Arg Trp Val Tyr Val Pro Lys Phe Ala Gly Ala Cys Ile His
Glu Tyr Thr Gly Asn Leu Gly Gly Trp Val Asp Lys Tyr Val Tyr Ser Ser Gly Trp Val Tyr Leu Glu
Ala Pro Ala Tyr Asp Pro Ala Asn Gly Gln Tyr Gly Tyr Ser Val Trp Ser Tyr Cys Gly Val Gly SEQ ID NO.: 65
atggccaagtactccgagctggaagaaggcggcgttataatgcaggccttctactgggacgtcccaggtggaggaatctggtggggcaccat
caggagcaagataccggagtggtacgaggcgggaatatccgccatttggattcctcccgcgagcaagggtatgagcggcggctattcgatgg
gctacgaccccctacgattattttgacctcggtgagtactaccagaagggaacggtggaaacgaggttcggctcaaagcaggagctcataaacat
gataaacaccgcccacgcctatggcatgaaggtaatagccgatatagtcatcaaccaccgcgccggcggtgacctggagtggaaccccttcgt
gaacgactatacctggaccgacttctcaaaggtcgcgtcgggtaaatacacggccaactacctcgacttccacccgaacgagctccatgcggg
cgattccggaacatttggaggctatcccgacatatgccacgacaagagctgggaccagtactggctctgggccagccaggagagctacgcgg
catatctcaggagcatcggcatcgatgcctggcgcttcgactacgtcaagggctatgctccctgggtcgtcaaggactggctgaactggtgggg
aggctgggcggttggagagtactgggacaccaacgtcgacgctgttctcaactgggcatactcgagcggtgccaaggtctttgacttcgccctc
tactacaagatggacgaggccttcgataacaacaacattcccgccctggtggacgccctcagatacggtcagacagtggtcagccgcgaccc
gttcaaggctgtgacgtttgtagccaaccacgataccgatataatttggaacaagtacccggcctacgccttcatcctcacctacgagggccagc
cgacgatattctaccgcgactacgaggagtggctcaacaaggacaggctcaagaacctcatctggatacacgaccacctcgccggtggaagc
acgagcatagtttactacgacagcgacgagatgatcttcgtgaggaacggctatggaagcaagcctggccttataacttacatcaacctcggctc
gagcaaggttggaaggtgggtttacgttccgaagttcgcaggctcgtgcatacacgagtacaccggcaatctcggcggctgggtggacaagt
gggtggactcaagcggctgggtctacctcgaggctcctgcccacgacccggccaacggccagtacggctactccgtctggagctattgcggt
gttggctga

Figure 16X

SEQ ID NO.: 66
Met Ala Lys Tyr Ser Glu Leu Glu Glu Gly Gly Val Ile Met Gln Ala Phe Tyr Trp Asp Val Pro Gly
Gly Gly Ile Trp Trp Gly Thr Ile Arg Ser Lys Ile Pro Glu Trp Tyr Glu Ala Gly Ile Ser Ala Ile Trp Ile
Pro Pro Ala Ser Lys Gly Met Ser Gly Gly Tyr Ser Met Gly Tyr Asp Pro Tyr Asp Tyr Phe Asp Leu
Gly Glu Tyr Tyr Gln Lys Gly Thr Val Glu Thr Arg Phe Gly Ser Lys Gln Glu Leu Ile Asn Met Ile
Asn Thr Ala His Ala Tyr Gly Met Lys Val Ile Ala Asp Ile Val Ile Asn His Arg Ala Gly Gly Asp
Leu Glu Trp Asn Pro Phe Val Asn Asp Tyr Thr Trp Thr Asp Phe Ser Lys Val Ala Ser Gly Lys Tyr
Thr Ala Asn Tyr Leu Asp Phe His Pro Asn Glu Leu His Ala Gly Asp Ser Gly Thr Phe Gly Gly Tyr
Pro Asp Ile Cys His Asp Lys Ser Trp Asp Gln Tyr Trp Leu Trp Ala Ser Gln Glu Ser Tyr Ala Ala
Tyr Leu Arg Ser Ile Gly Ile Asp Ala Trp Arg Phe Asp Tyr Val Lys Gly Tyr Ala Pro Trp Val Val
Lys Asp Trp Leu Asn Trp Trp Gly Gly Trp Ala Val Gly Glu Tyr Trp Asp Thr Asn Val Asp Ala Val
Leu Asn Trp Ala Tyr Ser Ser Gly Ala Lys Val Phe Asp Phe Ala Leu Tyr Tyr Lys Met Asp Glu Ala
Phe Asp Asn Asn Asn Ile Pro Ala Leu Val Asp Ala Leu Arg Tyr Gly Gln Thr Val Val Ser Arg Asp
Pro Phe Lys Ala Val Thr Phe Val Ala Asn His Asp Thr Asp Ile Ile Trp Asn Lys Tyr Pro Ala Tyr
Ala Phe Ile Leu Thr Tyr Glu Gly Gln Pro Thr Ile Phe Tyr Arg Asp Tyr Glu Glu Trp Leu Asn Lys
Asp Arg Leu Lys Asn Leu Ile Trp Ile His Asp His Leu Ala Gly Gly Ser Thr Ser Ile Val Tyr Tyr
Asp Ser Asp Glu Met Ile Phe Val Arg Asn Gly Tyr Gly Ser Lys Pro Gly Leu Ile Thr Tyr Ile Asn
Leu Gly Ser Ser Lys Val Gly Arg Trp Val Tyr Val Pro Lys Phe Ala Gly Ser Cys Ile His Glu Tyr
Thr Gly Asn Leu Gly Gly Trp Val Asp Lys Trp Val Asp Ser Ser Gly Trp Val Tyr Leu Glu Ala Pro
Ala His Asp Pro Ala Asn Gly Gln Tyr Gly Tyr Ser Val Trp Ser Tyr Cys Gly Val Gly

SEQ ID NO.: 67
atggccaagtacctggagctcgaagagggcggggtcataatgcaggcgttctactgggacgtgccttcgggaggaatatggtgggacacaat
acggcagaagataccggagtggtacgatgccggaatctccgcaatatggattcctcccgcgagcaagggtatgagcggcggctattcgatgg
gctacgacccctacgattattttgacctcggtgagtactaccagaagggaacggtggaaacgaggttcggctcaaagcaggagctcataaacat
gataaacacggcccatgcctacggcataaaggtcatagcggacatcgtcataaaccaccgcgcaggcggagacctcgagtggaacccgttc
gttggggactacacctggacggacttctcaaaggtggcctcgggcaaatatactgccaactacctcgacttccaccccaacgaggtcaagtgct
gtgacgagggcacatttggaggcttcccagacatagcccacgagaagagctgggaccagcactggctctgggcgagcgatgagagctacg
ccgcctacctaaggagcatcggcgttgatgcctggcgcttcgactacgtcaagggctacggagcgtgggtcgtcaaggactggctggactggt
ggggaggctgggccgtcggggagtactgggacacaaacgttgatgcactgctcaactgggcctactcgagcgatgcaaaagtcttcgacttc
ccgctctactacaagatggacgaggccttcgataacaacaacattcccgccctggtggacgccctcagatacggtcagacagtggtcagccgc
gacccgttcaaggctgtgacgtttgtagccaaccacgataccgatataatctggaacaagtatccagcctacgcgttcatcctcacctacgaggg
ccagccgacaatattctaccgcgactacgaggagtggctcaacaaggataagctcaagaacctcatctggatacatgacaacctcgccggag
gaagcacgagcatagtttactacgacagcgacgagatgatcttcgtgaggaacggctatggaagcaagcctggccttataacttacatcaacct
cggctcgagcaaggttggaaggtgggtctacgttccgaagttcgcgggagcgtgcatccacgagtacaccggcaacctcggcggctgggtg
gacaagtgggtggactcaagcgggtgggtgtacctcgaggcccctgcccacgacccggccaacggctattacggctactccgtctggagcta
ctgcgtggtgggctga SEQ ID NO.: 68
Met Ala Lys Tyr Leu Glu Leu Glu Glu Gly Gly Val Ile Met Gln Ala Phe Tyr Trp Asp Val Pro Ser
Gly Gly Ile Trp Trp Asp Thr Ile Arg Gln Lys Ile Pro Glu Trp Tyr Asp Ala Gly Ile Ser Ala Ile Trp
Ile Pro Pro Ala Ser Lys Gly Met Ser Gly Gly Tyr Ser Met Gly Tyr Asp Pro Tyr Asp Tyr Phe Asp
Leu Gly Glu Tyr Tyr Gln Lys Gly Thr Val Glu Thr Arg Phe Gly Ser Lys Gln Glu Leu Ile Asn Met
Ile Asn Thr Ala His Ala Tyr Gly Ile Lys Val Ile Ala Asp Ile Val Ile Asn His Arg Ala Gly Gly Asp
Leu Glu Trp Asn Pro Phe Val Gly Asp Tyr Thr Trp Thr Asp Phe Ser Lys Val Ala Ser Gly Lys Tyr
Thr Ala Asn Tyr Leu Asp Phe His Pro Asn Glu Val Lys Cys Cys Asp Glu Gly Thr Phe Gly Gly
Phe Pro Asp Ile Ala His Glu Lys Ser Trp Asp Gln His Trp Leu Trp Ala Ser Asp Glu Ser Tyr Ala
Ala Tyr Leu Arg Ser Ile Gly Val Asp Ala Trp Arg Phe Asp Tyr Val Lys Gly Tyr Gly Ala Trp Val
Val Lys Asp Trp Leu Asp Trp Trp Gly Gly Trp Ala Val Gly Glu Tyr Trp Asp Thr Asn Val Asp Ala
Leu Leu Asn Trp Ala Tyr Ser Ser Asp Ala Lys Val Phe Asp Phe Pro Leu Tyr Tyr Lys Met Asp Glu

Figure 16Y

Ala Phe Asp Asn Asn Asn Ile Pro Ala Leu Val Asp Ala Leu Arg Tyr Gly Gln Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Lys Leu Lys Asn Leu Ile Trp Ile His Asp Asn Leu Ala Gly Gly Ser Thr Ser Ile Val Tyr
Tyr Asp Ser Asp Glu Met Ile Phe Val Arg Asn Gly Tyr Gly Ser Lys Pro Gly Leu Ile Thr Tyr Ile
Asn Leu Gly Ser Ser Lys Val Gly Arg Trp Val Tyr Val Pro Lys Phe Ala Gly Ala Cys Ile His Glu
Tyr Thr Gly Asn Leu Gly Gly Trp Val Asp Lys Trp Val Asp Ser Ser Gly Trp Val Tyr Leu Glu Ala
Pro Ala His Asp Pro Ala Asn Gly Tyr Tyr Gly Tyr Ser Val Trp Ser Tyr Cys Val Val Gly

SEQ ID NO.: 73
atggctctggaagagggcgggcttataatgcaggccttctactgggacgtcccaggtggaggaatctggtgggacaccatagcccagaagat
acccgactgggcgagcgccgggatttcggcaatatggattcctcccgcgagtaagggcatgagcggcggctattcgatgggctacgacccct
acgatttcttcgacctcggtgagtactaccagaagggaagcgttgagaccgcttcggatcaaaagaggagcttgtgaacatgataaacaccgc
ccatgctcacaacatgaaggtcatagcggacatagtcatcaaccaccgcgccggcggcgacctggagtggaatcctttcaccaacagctacac
ctggaccgatttctcgaaggtcgcgtcgggcaagtacacggccaactacctcgacttccacccgaacgagcttcacgcgggcgattccggaa
catttggaggctatcccgacatatgccacgacaagagctggaccagcactggctctgggccagcaacgaaagctacgccgcctacctccgg
agcatcggcatcgacgcctggcgcttcgactacgtcaagggctacgctccctgggtcgttaagaactggctgaaccggtggggcggctgggc
ggttggagagtactgggacaccaacgtcgatgcactcctgagctgggcctacgacagcggtgctaaagtcttcgacttcccgctctactacaag
atggacgaggccttcgataacaacaacatccccgccctcgtggacgccctcaagaacggaggcacggtcgtcagccgcgacccgttcaaag
ccgtgaccttcgttgccaaccacgataccaacataatctggaacaagtatccggcctacgccttcatcctcacctatgagggacagccggcaat
attctaccgcgactacgaggagtggctcaacaaggacaggctcaggaacctcatctggatacacgaccacctcgcgggaggaagcacagac
atcatctactacgacagcgacgagcttatcttcgtgagaaacggctacggggacaagcccgggactgataacctacatcaacctcggctcaagc
aaggccggaaggtgggtctacgttccgaagttcgcaggctcgtgcatacacgagtacaccggcaacctcggcggctggattgacaagtgggt
tgactcaagcggtcgggtctaccttgaggccccgcccacgacccggccaacggccagtacggctactccgtatggagctactgcggtgttg
ggtga SEQ ID NO.: 74
Met Ala Leu Glu Glu Gly Gly Leu Ile Met Gln Ala Phe Tyr Trp Asp Val Pro Gly Gly Gly Ile Trp
Trp Asp Thr Ile Ala Gln Lys Ile Pro Asp Trp Ala Ser Ala Gly Ile Ser Ala Ile Trp Ile Pro Pro Ala
Ser Lys Gly Met Ser Gly Gly Tyr Ser Met Gly Tyr Asp Pro Tyr Asp Phe Phe Asp Leu Gly Glu Tyr
Tyr Gln Lys Gly Ser Val Glu Thr Arg Phe Gly Ser Lys Glu Glu Leu Val Asn Met Ile Asn Thr Ala
His Ala His Asn Met Lys Val Ile Ala Asp Ile Val Ile Asn His Arg Ala Gly Gly Asp Leu Glu Trp
Asn Pro Phe Thr Asn Ser Tyr Thr Trp Thr Asp Phe Ser Lys Val Ala Ser Gly Lys Tyr Thr Ala Asn
Tyr Leu Asp Phe His Pro Asn Glu Leu His Ala Gly Asp Ser Gly Thr Phe Gly Gly Tyr Pro Asp Ile
Cys His Asp Lys Ser Trp Asp Gln His Trp Leu Trp Ala Ser Asn Glu Ser Tyr Ala Ala Tyr Leu Arg
Ser Ile Gly Ile Asp Ala Trp Arg Phe Asp Tyr Val Lys Gly Tyr Ala Pro Trp Val Val Lys Asn Trp
Leu Asn Arg Trp Gly Gly Trp Ala Val Gly Glu Tyr Trp Asp Thr Asn Val Asp Ala Leu Leu Ser Trp
Ala Tyr Asp Ser Gly Ala Lys Val Phe Asp Phe Pro Leu Tyr Tyr Lys Met Asp Glu Ala Phe Asp
Asn Asn Asn Ile Pro Ala Leu Val Asp Ala Leu Lys Asn Gly Gly Thr Val Val Ser Arg Asp Pro Phe
Lys Ala Val Thr Phe Val Ala Asn His Asp Thr Asn Ile Ile Trp Asn Lys Tyr Pro Ala Tyr Ala Phe Ile
Leu Thr Tyr Glu Gly Gln Pro Ala Ile Phe Tyr Arg Asp Tyr Glu Glu Trp Leu Asn Lys Asp Arg Leu
Arg Asn Leu Ile Trp Ile His Asp His Leu Ala Gly Gly Ser Thr Asp Ile Ile Tyr Tyr Asp Ser Asp Glu
Leu Ile Phe Val Arg Asn Gly Tyr Gly Asp Lys Pro Gly Leu Ile Thr Tyr Ile Asn Leu Gly Ser Ser
Lys Ala Gly Arg Trp Val Tyr Val Pro Lys Phe Ala Gly Ser Cys Ile His Glu Tyr Thr Gly Asn Leu
Gly Gly Trp Ile Asp Lys Trp Val Asp Ser Ser Gly Arg Val Tyr Leu Glu Ala Pro Ala His Asp Pro
Ala Asn Gly Gln Tyr Gly Tyr Ser Val Trp Ser Tyr Cys Gly Val Gly SEQ ID NO.: 75
atggctctggaagagggcgggcttataatgcaggcattctactgggacgtcccatgggaggaatctggtgggacacgatagcccagaagat
ccccgactgggcaagcgccgggatttcggcgatatggattcccccgcgagcaagggtatgagcggcggctattcgatgggctacgacccct acgattatttgacctcggtgagtactaccagaagggaacggtggaaacaagattcggctcaaagcaggagctcataaacatgataaacaccg
cccacgcctatggcatgaaggtaatagccgatatagtcatcaaccaccgcgccggcggcgatctggagtggaaccccttcgtgaacgactata
cctggaccgacttctcgaaggtcgcgtcgggtaaatacacggccaactacctcgacttccacccgaacgagctccacgcgggcgattccgga
acatttggaggctatcccgacatatgccacgacaagagctgggaccagtactggctctgggccagccaggagagctacgcggcctatctcag
gagcatcggcatcgacgcctggcgcttcgactacgtcaagggctatgctccctgggtcgtcagggactggctgaactggtggggaggctggg
cagttggagagtactgggacaccaacgtcgacgctgttctcaactgggcatactcgagcggtgccaaggtctttgacttcgccctctactacaag
atggacgaggccttcgataacaacaacattcccgccctggtggacgccctcagatacggccagacagtggtcagccgcgacccgttcaaggc
tgtgacgtttgtagccaaccacgataccgacataatctggaacaagtatccagcctacgcgttcatcctcacctacgagggccagccgacaatat
tctaccgcgactacgaggagtggctcaacaaggacaagctcaagaacctcatctggatacatgacaacctcgccggagggagcactgacatc
gtttactacgacaacgacgagctgatattcgtgagaaacggctacggaagcaagccgggactgataacatacatcaacctcggctcaagcaaa
gccggaaggtgggtttacgttccgaagttcgcaggctcgtgcatacacgagtacaccggcaacctcggcggctgggtggacaagtgggtgga
ctcaagcggctgggtttacctcgaggctcctgcccacgacccggccaacggccagtacggctactccgtttggagctattgcggtgttgggtga SEQ ID NO.: 76
Met Ala Leu Glu Glu Gly Gly Leu Ile Met Gln Ala Phe Tyr Trp Asp Val Pro Met Gly Gly Ile Trp
Trp Asp Thr Ile Ala Gln Lys Ile Pro Asp Trp Ala Ser Ala Gly Ile Ser Ala Ile Trp Ile Pro Pro Ala
Ser Lys Gly Met Ser Gly Gly Tyr Ser Met Gly Tyr Asp Pro Tyr Asp Tyr Phe Asp Leu Gly Glu Tyr
Tyr Gln Lys Gly Thr Val Glu Thr Arg Phe Gly Ser Lys Gln Glu Leu Ile Asn Met Ile Asn Thr Ala
His Ala Tyr Gly Met Lys Val Ile Ala Asp Ile Val Ile Asn His Arg Ala Gly Gly Asp Leu Glu Trp
Asn Pro Phe Val Asn Asp Tyr Thr Trp Thr Asp Phe Ser Lys Val Ala Ser Gly Lys Tyr Thr Ala Asn
Tyr Leu Asp Phe His Pro Asn Glu Leu His Ala Gly Asp Ser Gly Thr Phe Gly Gly Tyr Pro Asp Ile
Cys His Asp Lys Ser Trp Asp Gln Tyr Trp Leu Trp Ala Ser Gln Glu Ser Tyr Ala Ala Tyr Leu Arg
Ser Ile Gly Ile Asp Ala Trp Arg Phe Asp Tyr Val Lys Gly Tyr Ala Pro Trp Val Val Arg Asp Trp
Leu Asn Trp Trp Gly Gly Trp Ala Val Gly Glu Tyr Trp Asp Thr Asn Val Asp Ala Val Leu Asn Trp
Ala Tyr Ser Ser Gly Ala Lys Val Phe Asp Phe Ala Leu Tyr Tyr Lys Met Asp Glu Ala Phe Asp Asn
Asn Asn Ile Pro Ala Leu Val Asp Ala Leu Arg Tyr Gly Gln Thr Val Val Ser Arg Asp Pro Phe Lys
Ala Val Thr Phe Val Ala Asn His Asp Thr Asp Ile Ile Trp Asn Lys Tyr Pro Ala Tyr Ala Phe Ile
Leu Thr Tyr Glu Gly Gln Pro Thr Ile Phe Tyr Arg Asp Tyr Glu Glu Trp Leu Asn Lys Asp Lys Leu
Lys Asn Leu Ile Trp Ile His Asp Asn Leu Ala Gly Gly Ser Thr Asp Ile Val Tyr Tyr Asp Asn Asp
Glu Leu Ile Phe Val Arg Asn Gly Tyr Gly Ser Lys Pro Gly Leu Ile Thr Tyr Ile Asn Leu Gly Ser Ser
Lys Ala Gly Arg Trp Val Tyr Val Pro Lys Phe Ala Gly Ser Cys Ile His Glu Tyr Thr Gly Asn Leu
Gly Gly Trp Val Asp Lys Trp Val Asp Ser Ser Gly Trp Val Tyr Leu Glu Ala Pro Ala His Asp Pro
Ala Asn Gly Gln Tyr Gly Tyr Ser Val Trp Ser Tyr Cys Gly Val Gly SEQ ID NO.: 77
atggctctggaagagggcgggctcataatgcaggccttctactgggacgtccccatgggaggaatctggtgggacacgatagcccagaagat
acccgactgggcaagcgccgggatttcggcgatatggatccctcccgcgagcaagggtatgagcggcggctattcgatgggctacgacccct
acgattatttgacctcggtgagtactaccagaagggaacggtggaaacgaggttcggctcaaagcaggagctcataaacatgataaacaccg
cccacgcctatggcatgaaggtaatagccgatatagtcatcaaccaccgcgccggcggtgacctggagtggaaccccttcgtgaacgactata
cctggaccgacttctcaaaggtcgcgtcgggtaaatacacggccaactacctcgacttccacccgaacgagctccatgcgggcgattccggaa
catttggaggctatcccgacatatgccacgacaagagctgggaccagtactggctctgggccagccaggagagctacgcggcatatctcagg
agcatcggcatcgatgcctggcgcttcgactacgtcaagggctatgctccctgggtcgtcaaggactggctgaactggtggggaggctgggc
ggttggagagtactgggacaccaacgtcgacgctgttctcaactgggcatactcgagcggtgccaaggtctttgacttcgccctctactacaaga
tggacgaggccttcgataacaacaacattcccgccctggtggacgccctcagatacggtcagacagtggtcagccgcgacccgttcaaggct
gtgacgtttgtagccaaccacgataccgacataatctggaacaagtatccagcctacgcgttcatcctcacctacgagggccagccgacaatatt
ctaccgcgactacgaggagtggctcaacaaggataagctcaagaacctcatctggatacatgacaacctcgccggagggagcactgacatcg
tttactacgacaacgacgagctgatattcgtgagaaacggctacggaagcaagccgggactgataacatacatcaacctcgcctcaagcaaag
ccggaaggtgggtttacgttccgaagttcgcaggctcgtgcatacacgagtacaccggcaatctcggcggctgggtggacaagtgggtggac
tcaagcggctgggtctacctcgaggctcctgcccacgacccggccaacggccagtacggctactccgtctggagctactgcggtgttgggtga

Figure 16AA

SEQ ID NO.: 78
Met Ala Leu Glu Glu Gly Gly Leu Ile Met Gln Ala Phe Tyr Trp Asp Val Pro Met Gly Gly Ile Trp
Trp Asp Thr Ile Ala Gln Lys Ile Pro Asp Trp Ala Ser Ala Gly Ile Ser Ala Ile Trp Ile Pro Pro Ala
Ser Lys Gly Met Ser Gly Gly Tyr Ser Met Gly Tyr Asp Pro Tyr Asp Tyr Phe Asp Leu Gly Glu Tyr
Tyr Gln Lys Gly Thr Val Glu Thr Arg Phe Gly Ser Lys Gln Glu Leu Ile Asn Met Ile Asn Thr Ala
His Ala Tyr Gly Met Lys Val Ile Ala Asp Ile Val Ile Asn His Arg Ala Gly Gly Asp Leu Glu Trp
Asn Pro Phe Val Asn Asp Tyr Thr Trp Thr Asp Phe Ser Lys Val Ala Ser Gly Lys Tyr Thr Ala Asn
Tyr Leu Asp Phe His Pro Asn Glu Leu His Ala Gly Asp Ser Gly Thr Phe Gly Gly Tyr Pro Asp Ile
Cys His Asp Lys Ser Trp Asp Gln Tyr Trp Leu Trp Ala Ser Gln Glu Ser Tyr Ala Ala Tyr Leu Arg
Ser Ile Gly Ile Asp Ala Trp Arg Phe Asp Tyr Val Lys Gly Tyr Ala Pro Trp Val Val Lys Asp Trp
Leu Asn Trp Trp Gly Gly Trp Ala Val Gly Glu Tyr Trp Asp Thr Asn Val Asp Ala Val Leu Asn Trp
Ala Tyr Ser Ser Gly Ala Lys Val Phe Asp Phe Ala Leu Tyr Tyr Lys Met Asp Glu Ala Phe Asp Asn
Asn Asn Ile Pro Ala Leu Val Asp Ala Leu Arg Tyr Gly Gln Thr Val Val Ser Arg Asp Pro Phe Lys
Ala Val Thr Phe Val Ala Asn His Asp Thr Asp Ile Ile Trp Asn Lys Tyr Pro Ala Tyr Ala Phe Ile
Leu Thr Tyr Glu Gly Gln Pro Thr Ile Phe Tyr Arg Asp Tyr Glu Glu Trp Leu Asn Lys Asp Lys Leu
Lys Asn Leu Ile Trp Ile His Asp Asn Leu Ala Gly Gly Ser Thr Asp Ile Val Tyr Tyr Asp Asn Asp
Glu Leu Ile Phe Val Arg Asn Gly Tyr Gly Ser Lys Pro Gly Leu Ile Thr Tyr Ile Asn Leu Ala Ser Ser
Lys Ala Gly Arg Trp Val Tyr Val Pro Lys Phe Ala Gly Ser Cys Ile His Glu Tyr Thr Gly Asn Leu
Gly Gly Trp Val Asp Lys Trp Val Asp Ser Ser Gly Trp Val Tyr Leu Glu Ala Pro Ala His Asp Pro
Ala Asn Gly Gln Tyr Gly Tyr Ser Val Trp Ser Tyr Cys Gly Val Gly

SEQ ID NO.: 79
atgaagcctgcgaaactcctcgtctttgtgctcgtagtctctatcctcgcggggctctacgcccagcccgcggggggcggccaagtacctggagc
tcgaagagggcggcgtcataatgcaggcgttctactgggacgtgccttcaggaggaatatggtggacacaatacggcagaagataccgga
gtggtacgatgccggaatctccgcaatatggattccccggcgagcaagggcatgggcggcgcctattcgatgggctacgaccccctacgactt
ctttgacctcggtgagtacgaccagaagggaacggtagagacgcgctttggctccaagcaggagctcgtgaacatgataaacaccgcccacg
cctacggcatcaaggtcatcgcagacatagtaatcaaccaccgcgccggaggagaccttgagtggaaccccttcgtcaatgactacacctgga
cggacttctcgaaggtcgcttccggcaagtacacggccaactacctcgacttccaccccaacgaggtcaagtgctgcgacgagggcacctttg
gagggttcccggacatagcccacgagaagagctgggaccagtactggctctgggcgagcaacgagagctacgccgcctacctcaggagca
tcggcgttgacgcatggcgcttcgactacgtcaagggctacggagcgtgggtcgtcaaggactggctggactggtggggaggctgggccgt
cggggagtactgggacacaaacgttgatgcactgctcaactgggcctactcgagcgatgcaaaagtcttcgacttcccgctctactacaagatg
gacgcggcctttgacaacaagaacattcccgcactcgtcgaggccctcaagaacgggggcacagtcgtcagccgcgaccegtttaaggccgt
aaccttcgttgcaaaccacgacacggacataatttggaacaagtacccggcctacgccttcatcctcacctacgagggccagccgacgatattc
taccgcgactacgaggagtggctcaacaaggacaggctcaagaacctcatctggatacacgaccacctcgccggtggaagcaccgacatag
tctactacgataacgatgaactcatcttcgtcaggaacggctacggggacaagccggggcttataacctacatcaacctaggctcgagcaagg
ccggggaggtgggtctacgttccgaagttcgcgggagcgtgcatccacgagtacaccggcaacctcggcggctgggtggacaagtgggtgga
ctcaagcgggtgggtgtacctcgaggcccctgcccacgacccggccaacggctattacggctactccgtctggagctactgcggggtgggct
ga SEQ ID NO.: 80
Met Lys Pro Ala Lys Leu Leu Val Phe Val Leu Val Val Ser Ile Leu Ala Gly Leu Tyr Ala Gln Pro
Ala Gly Ala Ala Lys Tyr Leu Glu Leu Glu Glu Gly Gly Val Ile Met Gln Ala Phe Tyr Trp Asp Val
Pro Ser Gly Gly Ile Trp Trp Asp Thr Ile Arg Gln Lys Ile Pro Glu Trp Tyr Asp Ala Gly Ile Ser Ala
Ile Trp Ile Pro Pro Ala Ser Lys Gly Met Gly Gly Ala Tyr Ser Met Gly Tyr Asp Pro Tyr Asp Phe
Phe Asp Leu Gly Glu Tyr Asp Gln Lys Gly Thr Val Glu Thr Arg Phe Gly Ser Lys Gln Glu Leu Val
Asn Met Ile Asn Thr Ala His Ala Tyr Gly Ile Lys Val Ile Ala Asp Ile Val Ile Asn His Arg Ala Gly
Gly Asp Leu Glu Trp Asn Pro Phe Val Asn Asp Tyr Thr Trp Thr Asp Phe Ser Lys Val Ala Ser Gly
Lys Tyr Thr Ala Asn Tyr Leu Asp Phe His Pro Asn Glu Val Lys Cys Cys Asp Glu Gly Thr Phe
Gly Gly Phe Pro Asp Ile Ala His Glu Lys Ser Trp Asp Gln Tyr Trp Leu Trp Ala Ser Asn Glu Ser
Tyr Ala Ala Tyr Leu Arg Ser Ile Gly Val Asp Ala Trp Arg Phe Asp Tyr Val Lys Gly Tyr Gly Ala

Figure 16BB

Trp Val Val Lys Asp Trp Leu Asp Trp Trp Gly Gly Trp Ala Val Gly Glu Tyr Trp Asp Thr Asn Val
Asp Ala Leu Leu Asn Trp Ala Tyr Ser Ser Asp Ala Lys Val Phe Asp Phe Pro Leu Tyr Tyr Lys Met
Asp Ala Ala Phe Asp Asn Lys Asn Ile Pro Ala Leu Val Glu Ala Leu Lys Asn Gly Gly Thr Val Val
Ser Arg Asp Pro Phe Lys Ala Val Thr Phe Val Ala Asn His Asp Thr Asp Ile Ile Trp Asn Lys Tyr
Pro Ala Tyr Ala Phe Ile Leu Thr Tyr Glu Gly Gln Pro Thr Ile Phe Tyr Arg Asp Tyr Glu Glu Trp
Leu Asn Lys Asp Arg Leu Lys Asn Leu Ile Trp Ile His Asp His Leu Ala Gly Gly Ser Thr Asp Ile
Val Tyr Tyr Asp Asn Asp Glu Leu Ile Phe Val Arg Asn Gly Tyr Gly Asp Lys Pro Gly Leu Ile Thr
Tyr Ile Asn Leu Gly Ser Ser Lys Ala Gly Arg Trp Val Tyr Val Pro Lys Phe Ala Gly Ala Cys Ile
His Glu Tyr Thr Gly Asn Leu Gly Gly Trp Val Asp Lys Trp Val Asp Ser Ser Gly Trp Val Tyr Leu
Glu Ala Pro Ala His Asp Pro Ala Asn Gly Tyr Tyr Gly Tyr Ser Val Trp Ser Tyr Cys Gly Val Gly

SEQ ID NO.: 81
atgaagaagtttgtcgccctgttcataaccatgttttcgtagtgagcatggcagtcgttgcacagccagctagcgccgcaaagtattccgagctc
gaagaaggcggcgttataatgcaggccttctactgggacgtcccaggtggaggaatctggtgggacaccatcaggagcaagataccggagt
ggtacgaggcgggaatatccgccatttggattccgccagccagcaaggggatgagcggcggttactcgatgggctacgatccctacgatttctt
tgacctcggcgagtacaaccagaagggaaccatcgaaacgcgctttggctctaaacaggagctcatcaatatgataaacacggcccatgccta
cggcataaaggtcatagcggacatcgtcataaaccaccgcgcaggcggagacctcgagtggaacccgttcgttggggactacacctggacg
gacttctcaaaggtggcctcgggcaaatatactgccaactacctcgacttccaccccaacgaggtcaagtgctgtgacgagggcacatttggag
gcttcccagacatagccacgagaagagctgggaccagcactggctctgggcgagcgatgagagctacgccgcctacctaaggagcatcg
gcgttgatgcctggcgctttgactacgtgaagggctacggagcgtgggtcgtcaaggactggctcaactggtggggcggctgggccgttggc
gagtactgggacaccaacgttgatgcactcctcaactgggcctactcgagcggcgccaaggtcttcgacttccgctctactacaagatggatg
aggcctttgacaacaaaaacattccagcgctcgtctctgcccttcagaacggccagactgttgtctcccgcgacccgttcaaggccgtaacctt
gtagcaaaccacgacaccgatataatctggaacaagtaccttgcttatgctttcatcctcacctacgaaggccagcccgtcatattctaccgcgac
tacgaggagtggctcaacaaggacaggttgaacaacctcatatggatacacgaccacctcgcaggtggaagcacgagcatagtctactacga
cagcgacgagatgatcttcgtgaggaacggctatggaagcaagcctggcctataacttacatcaacctcggctcgagcaaggttggaaggtg
ggtttatgtgccgaagttcgcgggcgcgtgcatccacgagtatactggtaacctcggaggctgggtagacaagtacgtctactcaagcggctg
ggtctatctcgaagctccagcttacgaccctgccaacgggcagtatggctactccgtgtggagctattgcggtgttgggtga SEQ ID NO.: 82
Met Lys Lys Phe Val Ala Leu Phe Ile Thr Met Phe Phe Val Val Ser Met Ala Val Val Ala Gln Pro
Ala Ser Ala Ala Lys Tyr Ser Glu Leu Glu Glu Gly Gly Val Ile Met Gln Ala Phe Tyr Trp Asp Val
Pro Gly Gly Gly Ile Trp Trp Asp Thr Ile Arg Ser Lys Ile Pro Glu Trp Tyr Glu Ala Gly Ile Ser Ala
Ile Trp Ile Pro Pro Ala Ser Lys Gly Met Ser Gly Gly Tyr Ser Met Gly Tyr Asp Pro Tyr Asp Phe
Phe Asp Leu Gly Glu Tyr Asn Gln Lys Gly Thr Ile Glu Thr Arg Phe Gly Ser Lys Gln Glu Leu Ile
Asn Met Ile Asn Thr Ala His Ala Tyr Gly Ile Lys Val Ile Ala Asp Ile Val Ile Asn His Arg Ala Gly
Gly Asp Leu Glu Trp Asn Pro Phe Val Gly Asp Tyr Thr Trp Thr Asp Phe Ser Lys Val Ala Ser Gly
Lys Tyr Thr Ala Asn Tyr Leu Asp Phe His Pro Asn Glu Val Lys Cys Cys Asp Glu Gly Thr Phe
Gly Gly Phe Pro Asp Ile Ala His Glu Lys Ser Trp Asp Gln His Trp Leu Trp Ala Ser Asp Glu Ser
Tyr Ala Ala Tyr Leu Arg Ser Ile Gly Val Asp Ala Trp Arg Phe Asp Tyr Val Lys Gly Tyr Gly Ala
Trp Val Val Lys Asp Trp Leu Asn Trp Trp Gly Gly Trp Ala Val Gly Glu Tyr Trp Asp Thr Asn Val
Asp Ala Leu Leu Asn Trp Ala Tyr Ser Ser Gly Ala Lys Val Phe Asp Phe Pro Leu Tyr Tyr Lys Met
Asp Glu Ala Phe Asp Asn Lys Asn Ile Pro Ala Leu Val Ser Ala Leu Gln Asn Gly Gln Thr Val Val
Ser Arg Asp Pro Phe Lys Ala Val Thr Phe Val Ala Asn His Asp Thr Asp Ile Ile Trp Asn Lys Tyr
Leu Ala Tyr Ala Phe Ile Leu Thr Tyr Glu Gly Gln Pro Val Ile Phe Tyr Arg Asp Tyr Glu Glu Trp
Leu Asn Lys Asp Arg Leu Asn Asn Leu Ile Trp Ile His Asp His Leu Ala Gly Gly Ser Thr Ser Ile
Val Tyr Tyr Asp Ser Asp Glu Met Ile Phe Val Arg Asn Gly Tyr Gly Ser Lys Pro Gly Leu Ile Thr
Tyr Ile Asn Leu Gly Ser Ser Lys Val Gly Arg Trp Val Tyr Val Pro Lys Phe Ala Gly Ala Cys Ile
His Glu Tyr Thr Gly Asn Leu Gly Gly Trp Val Asp Lys Tyr Val Tyr Ser Ser Gly Trp Val Tyr Leu
Glu Ala Pro Ala Tyr Asp Pro Ala Asn Gly Gln Tyr Gly Tyr Ser Val Trp Ser Tyr Cys Gly Val Gly SEQ ID NO.: 83
atggctctggaagacggcgggctcataatgcaggccttctactgggatgttcctggaggaggaatctggtgggacacaatagctcaaaagata
cccgaatgggcaagtgcaggaatctcagcgatatggattccaccagcgagtaagggcatgagcggtggttattccatgggctacgatccctac
gatttctttgacctcggcgagtactatcagaaggggacagttgagacgcgcttcggctcaaaggaagaactggtgaacatgataaacaccgca
cactcctacggcataaaggtgatagcagacatagtcataaaccaccgcgccggtggagaccttgagtggaaccccttcgtgaacgactatacct
ggacagacttctcaaaagtcgcctccggtaaatatacggccaactaccttgacttccacccaaacgagcttcactgttgtgatgaaggtacctttg
gaggataccctgatatatgtcacgacaaaagctgggaccagtactggctctgggcgagcagcgaaagctacgctgcctacctcaggagcata
ggggttgacgcctggcgtttcgactacgtcaagggctacggagcatggggttgttaacgactggctcagctggtggggaggctgggccgttgga
gagtactgggacacgaacgttgatgcactcctcaactgggcatacagcagcggcgccaaggtctttgacttcccgctctactacaagatggacg
aagccttcgacaacaccaacatcccggcattagtggatgcactcagatacggccagacagtggtcagccgcgatcccttcaaggcggtaacttt
cgttgccaaccacgatacagatataatctggaacaagtatccggcttatgcattcatccttacctatgagggacagcctgttatattctaccgcgac
tacgaggagtggctcaacaaggataagcttaacaacctcatctggatacacgatcaccttgctggagggagtactgacattgtttactacgacag
cgacgagcttatctttgtgagaaacggctatggcaccaaaccaggactgataacctatatcaacctcggctcaagcaaagttggaaggtgggtc
tacgttccaaagttcgccggttcatgcatccacgagtacaccggcaacctcggcggttggatagacaagtacgtctcctccagcggctgggtct
atcttgaggccccagcccacgacccggcgaacggctactacggctactccgtatggagctactgcgggggttgggtga SEQ ID NO.: 84
Met Ala Leu Glu Asp Gly Gly Leu Ile Met Gln Ala Phe Tyr Trp Asp Val Pro Gly Gly Gly Ile Trp
Trp Asp Thr Ile Ala Gln Lys Ile Pro Glu Trp Ala Ser Ala Gly Ile Ser Ala Ile Trp Ile Pro Pro Ala
Ser Lys Gly Met Ser Gly Gly Tyr Ser Met Gly Tyr Asp Pro Tyr Asp Phe Phe Asp Leu Gly Glu Tyr
Tyr Gln Lys Gly Thr Val Glu Thr Arg Phe Gly Ser Lys Glu Glu Leu Val Asn Met Ile Asn Thr Ala
His Ser Tyr Gly Ile Lys Val Ile Ala Asp Ile Val Ile Asn His Arg Ala Gly Gly Asp Leu Glu Trp Asn
Pro Phe Val Asn Asp Tyr Thr Trp Thr Asp Phe Ser Lys Val Ala Ser Gly Lys Tyr Thr Ala Asn Tyr
Leu Asp Phe His Pro Asn Glu Leu His Cys Cys Asp Glu Gly Thr Phe Gly Gly Tyr Pro Asp Ile Cys
His Asp Lys Ser Trp Asp Gln Tyr Trp Leu Trp Ala Ser Ser Glu Ser Tyr Ala Ala Tyr Leu Arg Ser
Ile Gly Val Asp Ala Trp Arg Phe Asp Tyr Val Lys Gly Tyr Gly Ala Trp Val Val Asn Asp Trp Leu
Ser Trp Trp Gly Gly Trp Ala Val Gly Glu Tyr Trp Asp Thr Asn Val Asp Ala Leu Leu Asn Trp Ala
Tyr Ser Ser Gly Ala Lys Val Phe Asp Phe Pro Leu Tyr Tyr Lys Met Asp Glu Ala Phe Asp Asn Thr
Asn Ile Pro Ala Leu Val Asp Ala Leu Arg Tyr Gly Gln Thr Val Val Ser Arg Asp Pro Phe Lys Ala
Val Thr Phe Val Ala Asn His Asp Thr Asp Ile Ile Trp Asn Lys Tyr Pro Ala Tyr Ala Phe Ile Leu
Thr Tyr Glu Gly Gln Pro Val Ile Phe Tyr Arg Asp Tyr Glu Glu Trp Leu Asn Lys Asp Lys Leu Asn
Asn Leu Ile Trp Ile His Asp His Leu Ala Gly Gly Ser Thr Asp Ile Val Tyr Tyr Asp Ser Asp Glu
Leu Ile Phe Val Arg Asn Gly Tyr Gly Thr Lys Pro Gly Leu Ile Thr Tyr Ile Asn Leu Gly Ser Ser
Lys Val Gly Arg Trp Val Tyr Val Pro Lys Phe Ala Gly Ser Cys Ile His Glu Tyr Thr Gly Asn Leu
Gly Gly Trp Ile Asp Lys Tyr Val Ser Ser Ser Gly Trp Val Tyr Leu Glu Ala Pro Ala His Asp Pro
Ala Asn Gly Tyr Tyr Gly Tyr Ser Val Trp Ser Tyr Cys Gly Val Gly SEQ ID NO.: 85
atggctctggaagagggcgggcttataatgcaggccattctattgggacgtcccaggtggaggaatctggtgggacaccatagcccagaagata
cccgaatgggcaagtgcaggaatctcagcgatatggattccaccagcgagtaagggaatgagcggtggttattccatgggctacgatccctac
gatttctttgacctcggcgagtactatcagaaggggacagttgagacgcgcttcggctcaaaggaagaactggtgaacatgataaacaccgca
cactcctacggcataaaggtgatagcggacatagtcataaaccaccgcgccggtggaggcctcgagtggaaccccttcgtgaacgactatacc
tggacagacttctcaaaagtcgcctccggtaaatatacagccaactaccttgacttccacccaaacgagcttcactgttgtgatgaaggtacctttg
gaggataccctgatatatgtcacgacaaaagctgggaccagtactggctctgggcgagcagcgaaagctacgctgcctacctcaggagcata
ggggttgacgcctggtgtttcgactacgtcaagggctacggagcctgggttgttaacgactggctcagctggtggggaggctgggccgttgga
gagtactgggacactaacgttgatgcactcctcaactgggcatacaacagcggcgccaaggtctttgacttcccgctctactacaagatggacg
aagccttcgacaataccaacatcccggctttggtttacgccctcaagaatggcgggacagtggtcagccgcgacccattcaaggcggtaacttt
cgttgccaaccacgatacagatataatctggaacaagtatccggcttatgcattcatccttacctatgagggacagcctgttatattctaccgcgac
tacgaggagtggctcaacaaggataagcttaacaacctcatctggatacacgatcaccttgctggagggagtactgacattgtttactacgacag
cgacgagcttatctttgtgagaaacggctatggcaccaaaccaggactgataacctatatcaacctcggctcaagcaaagctggaaggtgggtc

Figure 16DD tacgttccaaagttcgccggttcatgcatccacgagtacaccggcagcctcggcggttggatagacaagtacgtctcctccagcggctgggtct
accttgaggccccggcccacgacccggccaatggccagtatggctactccgtctggagctattgcggggttggggtga SEQ ID NO.: 86
Met Ala Leu Glu Glu Gly Gly Leu Ile Met Gln Ala Phe Tyr Trp Asp Val Pro Gly Gly Gly Ile Trp
Trp Asp Thr Ile Ala Gln Lys Ile Pro Glu Trp Ala Ser Ala Gly Ile Ser Ala Ile Trp Ile Pro Pro Ala
Ser Lys Gly Met Ser Gly Gly Tyr Ser Met Gly Tyr Asp Pro Tyr Asp Phe Phe Asp Leu Gly Glu Tyr
Tyr Gln Lys Gly Thr Val Glu Thr Arg Phe Gly Ser Lys Glu Glu Leu Val Asn Met Ile Asn Thr Ala
His Ser Tyr Gly Ile Lys Val Ile Ala Asp Ile Val Ile Asn His Arg Ala Gly Gly Gly Leu Glu Trp Asn
Pro Phe Val Asn Asp Tyr Thr Trp Thr Asp Phe Ser Lys Val Ala Ser Gly Lys Tyr Thr Ala Asn Tyr
Leu Asp Phe His Pro Asn Glu Leu His Cys Cys Asp Glu Gly Thr Phe Gly Gly Tyr Pro Asp Ile Cys
His Asp Lys Ser Trp Asp Gln Tyr Trp Leu Trp Ala Ser Ser Glu Ser Tyr Ala Ala Tyr Leu Arg Ser
Ile Gly Val Asp Ala Trp Cys Phe Asp Tyr Val Lys Gly Tyr Gly Ala Trp Val Val Asn Asp Trp Leu
Ser Trp Trp Gly Gly Trp Ala Val Gly Glu Tyr Trp Asp Thr Asn Val Asp Ala Leu Leu Asn Trp Ala
Tyr Asn Ser Gly Ala Lys Val Phe Asp Phe Pro Leu Tyr Tyr Lys Met Asp Glu Ala Phe Asp Asn
Thr Asn Ile Pro Ala Leu Val Tyr Ala Leu Lys Asn Gly Gly Thr Val Val Ser Arg Asp Pro Phe Lys
Ala Val Thr Phe Val Ala Asn His Asp Thr Asp Ile Ile Trp Asn Lys Tyr Pro Ala Tyr Ala Phe Ile
Leu Thr Tyr Glu Gly Gln Pro Val Ile Phe Tyr Arg Asp Tyr Glu Glu Trp Leu Asn Lys Asp Lys Leu
Asn Asn Leu Ile Trp Ile His Asp His Leu Ala Gly Gly Ser Thr Asp Ile Val Tyr Tyr Asp Ser Asp
Glu Leu Ile Phe Val Arg Asn Gly Tyr Gly Thr Lys Pro Gly Leu Ile Thr Tyr Ile Asn Leu Gly Ser
Ser Lys Ala Gly Arg Trp Val Tyr Val Pro Lys Phe Ala Gly Ser Cys Ile His Glu Tyr Thr Gly Ser
Leu Gly Gly Trp Ile Asp Lys Tyr Val Ser Ser Ser Gly Trp Val Tyr Leu Glu Ala Pro Ala His Asp
Pro Ala Asn Gly Gln Tyr Gly Tyr Ser Val Trp Ser Tyr Cys Gly Val Gly SEQ ID NO: 87
atgttcctgctcgcgttttgctcactgcctcgctgttctgcccaacaggacagcccgccaaggctgccgcaccgtttaacggcaccatgatgca
gtattttgaatggtacttgccggatgatggcacgttatggaccaaagtggccaatgaagccaacaacttatccagccttggcatcaccgctcttg
gctgccgcccgcttacaaaggaacaagccgcagcgacgtagggtacggagtatacgacttgtatgacctcggcgaattcaatcaaaaaggga
ccgtccgcacaaaatacggaacaaaagctcaatatcttcaagccattcaagccgcccacgccgctggaatgcaagtgtacgccgatgtcgtgtt
cgaccataaaggcggcgctgacggcacggaatgggtggacgccgtcgaagtcaatccgtccgaccgcaaccaagaaatctcgggcacctat
caaatccaagcatggacgaaatttgattttccgggcgggcaacacctactccagctttaagtggcgctggtaccattttgacggcgttgattgg
gacgaaagccgaaaattgagccgcatttacaaattccgcggcatcggcaaagcgtgggattgggaagtagacacggaaaacggaaactatg
actacttaatgtatgccgaccttgatatggatcatcccgaagtcgtgaccgagctgaaaaactggggaaatggtatgtcaacacaacgaacatt
gatgggttccggcttgatgccgtcaagcatattaagttcagttttttcctgattggttgtcgtatgtgcgttctcagactggcaagccgctatttaccg
tcggggaatattggagctatgacatcaacaagttgcacaattacattacgaaaacagacggaacgatgtctttgtttgatgccccgttacacaaca
aattttataccgcttccaaatcagggggcgcatttgatatgcgcacgttaatgaccaatactctcatgaaagatcaaccgacattggccgtcacctt
cgttgataatcatgacaccgaacccggccaagcgctgcagtcatgggtcgacccatggttcaaaccgttggcttacgccttttattctaactcggc
aggaaggatacccgtgcgtctttatggtgactattatggcattccacaatataacattccttcgctgaaaagcaaaatcgatccgctcctcatcgc
gcgcagggattatgcttacggaacgcaacatgattatcttgatcactccgacatcatcgggtggacaagggaagggtcactgaaaaaccagg
atccgggctggccgcactgatcaccgatgggccgggaggaagcaaatggatgtactgttggcaaacaacacgctggaaaagtgttctatga SEQ ID NO: 88
Met Phe Leu Leu Ala Phe Leu Leu Thr Ala Ser Leu Phe Cys Pro Thr Gly Gln Pro Ala Lys Ala Ala
Ala Pro Phe Asn Gly Thr Met Met Gln Tyr Phe Glu Trp Tyr Leu Pro Asp Asp Gly Thr Leu Trp Thr
Lys Val Ala Asn Glu Ala Asn Asn Leu Ser Ser Leu Gly Ile Thr Ala Leu Trp Leu Pro Pro Ala Tyr
Lys Gly Thr Ser Arg Ser Asp Val Gly Tyr Gly Val Tyr Asp Leu Tyr Asp Leu Gly Glu Phe Asn Gln
Lys Gly Thr Val Arg Thr Lys Tyr Gly Thr Lys Ala Gln Tyr Leu Gln Ala Ile Gln Ala Ala His Ala
Ala Gly Met Gln Val Tyr Ala Asp Val Val Phe Asp His Lys Gly Gly Ala Asp Gly Thr Glu Trp Val
Asp Ala Val Glu Val Asn Pro Ser Asp Arg Asn Gln Glu Ile Ser Gly Thr Tyr Gln Ile Gln Ala Trp
Thr Lys Phe Asp Phe Pro Gly Arg Gly Asn Thr Tyr Ser Ser Phe Lys Trp Arg Trp Tyr His Phe Asp

Figure 16EE

Gly Val Asp Trp Asp Glu Ser Arg Lys Leu Ser Arg Ile Tyr Lys Phe Arg Gly Ile Gly Lys Ala Trp
Asp Trp Glu Val Asp Thr Glu Asn Gly Asn Tyr Asp Tyr Leu Met Tyr Ala Asp Leu Asp Met Asp
His Pro Glu Val Val Thr Glu Leu Lys Asn Trp Gly Lys Trp Tyr Val Asn Thr Thr Asn Ile Asp Gly
Phe Arg Leu Asp Ala Val Lys His Ile Lys Phe Ser Phe Phe Pro Asp Trp Leu Ser Tyr Val Arg Ser
Gln Thr Gly Lys Pro Leu Phe Thr Val Gly Glu Tyr Trp Ser Tyr Asp Ile Asn Lys Leu His Asn Tyr
Ile Thr Lys Thr Asp Gly Thr Met Ser Leu Phe Asp Ala Pro Leu His Asn Lys Phe Tyr Thr Ala Ser
Lys Ser Gly Gly Ala Phe Asp Met Arg Thr Leu Met Thr Asn Thr Leu Met Lys Asp Gln Pro Thr
Leu Ala Val Thr Phe Val Asp Asn His Asp Thr Glu Pro Gly Gln Ala Leu Gln Ser Trp Val Asp Pro
Trp Phe Lys Pro Leu Ala Tyr Ala Phe Ile Leu Thr Arg Gln Glu Gly Tyr Pro Cys Val Phe Tyr Gly
Asp Tyr Tyr Gly Ile Pro Gln Tyr Asn Ile Pro Ser Leu Lys Ser Lys Ile Asp Pro Leu Leu Ile Ala Arg
Arg Asp Tyr Ala Tyr Gly Thr Gln His Asp Tyr Leu Asp His Ser Asp Ile Ile Gly Trp Thr Arg Glu
Gly Val Thr Glu Lys Pro Gly Ser Gly Leu Ala Ala Leu Ile Thr Asp Gly Pro Gly Gly Ser Lys Trp
Met Tyr Cys Trp Gln Thr Thr Arg Trp Lys Ser Val Leu

SEQ ID NO: 89
atgaaagaagcggttgtgtatcaaatttttcccggatcggttctttaatggcaacccttcaaatgataacagcaagcagcaggcacgcggggcgc
agccgattgagcatcgcgattggtcggatttgcccgataatccgcgcctgaaagggacgagcggctacgatggcgacggtgaatggtcgaat
gacttttttcggcggagacatcgccggaattgaacaaaagttggattatttgcagtcgcttggagtgaacacgatttacttaaatccgatcgccaatg
cgccatcgaaccataaatatgatgcgagcaattacaaagaattggatccgatgttcggttccccggaagaattccaatcgtttgtgcaggcgcttg
cgaaccgggggatgcatctcatcttagacggggtgttcaaccacgtatccgacgattcgatttactttgaccgctaccaccgctatccgaccgtc
ggtgcgtatgaatattgggaagcggtttacgatttgatgaatgaaaaaggattgagcgaggaagaagcgcggaaacaagtggaagagaagttc
aaacaagagggacagacgttcagcccgtatgggtttcatctttggttcaatattgaaaacaaaaaagtcaatggccattatcaataccaatcatggt
ggggctatgacagtctgccggagtttaagtcggtgacgggggaaaaagtgccgcatccgagtgaattgaacaacgatgcgctcgcgaattac
atttttccgtgaatcggattcggtggcgaaaagctggattgccctcggcgcctccggctggcggttggatgtggccaatgaggtggatccggcgt
tttggcgcgagtttcgccaagaattgcttcaagggtcgtacggccgcggtccgacgttaaaagaggggggagcagccgctcattttaggggaaa
tttgggatgacgcatcgaaatattttctaggcgaccagtacgattccgtgatgaactaccggttccgcggggcggtgcttgacttttttgaaaaacg
gaaatgcagaagaggcggacaagcggctgacggccataagggaagactacccaagtgaagcgttttatgcgctgatgaacttaatcggttcg
catgacacggcgcgggcggtcttctgcttgggaacggaacggattcatccgagcgggcggagcttgatccgaattataatgaggaacttggg
aaaaagcggctcaagctggcggtgattttgcagatgggataccccggggagcgccgacgatttattacggcgatgaagcgggagtaacaggctc
aaaagacccagacaaccgccgcacgtatccgtggggcaaagaagatcaaaatctgttgtcccattatcagaaagtgggggcacattcgccagc
accatcaatcgttgttggcccatggcgacatcaagacggtgtatgcgcaaggggatgtatacgtatttgcccgccaatacgggcgtgaagcgg
cgctcattgccatcaaccgcggcaatgaggacaagacggtggcgcttgacgtcgcttcgttgcttccgaacggcaccgtgcttacggatgagtt
gcatgatggcggggaagctacggtcgctggcggaacgttgacggtcacgattccggccctggatggacggatgatgtttgggacggtgacg
gcggaaatgccggcagcagtcagcaatttgcaggcgagcgcttcggatggctgcgtgacgttaacgtgggaaggaaatgcatcgagatacc
gaatttacgagtccacgttaaaaggtgccggttatacgatggtgcaagagacggaaacaacttcggccacgatcggttcgttgacgaacggaa
cagcctattactttgccgttgcggcggtcgatgaaaacgggaatgaatcaccgaaggtcgaaacgaatcgcgtcgttcctcattacccgctgac
gagcgacaatgtccagttcgtgacaacgttaagcgatgccacactggatttgtcaaagccgcagcaagtggatgtccatgtcaacatcgacaat
gtgacaagcaaaggagcagctgatgggttgcaagcggtgttgcaagtgaaaggcccgcatgacgaaacatggaaagaatacagagcggctt
accaaggacaagacggcgacgccaacgtgttccgagctgccttcactccgctcgccgcagggacgtatacgtatcgttatgcgctgacgacc
aaccttggcgaggagtggatgtatacagaagagaagcaagtgacgtttgcggcagacaacagcgaccaaatagcgccagcagacgccatcg
agctgcggcagcctgcggttgaatcgggacaagtgaatttatcatggacgtttgttgggaaaaaagatggggatgcttatttgttagccatcgag
cgcaacggtgatatcgtgcatacaaccacttcgatcggcgattcatttacagactacgatgtcgaaaacggcaccgagtacacgtatgttgtcaa
gttgtatgaccgcgccggcaatgttgtggcgtcaaacacggtcaaggtgacgccggacattgtgatggtgaaagtgattttttaaagtgagagcg
ccggattacacaccgttggatgcccgaattacgattccgaacagcttgaacggctggaacacaggggcctgggagatgtcgcgcaacggtgc
ggtgacgcccgattggcaatttaccgtcgaggtgcaggaaggggaaacgatcacctataagtatgtgaaaggcggatcgtgggatcaagagg
ggttggccgaccatacgcgtgaggacgacaacgatgatgacgtgagctactacggctatgggacgattggcaccgacttgaaagtgacggtc
cacaatgaaggaaacaatacgatgattgtgcaagaccgcattttgcgctggatcgatatgccggtcgtcatcgaagaggtgcaaaaacaagga
agtcaagtgacgatcaagggcaatgccattaaaaacggtgttttgacgatcaatggcgagcgggtgccgattgatggccggatggcattctcgt
acacgtttgcgccggccagccatcaaaaagaagtgttgatccatatcgaaccatcggccgaaagcaaaacagccattttcaacaacgacggcg

Figure 16FF gagcgattgcgaaaaacacaaaagattacgtgctgaatttagaaacgaagcaattcaaaaagcttctcgagagtacttctagagcggccgcgg
gcccatcgattttccacccgggtggggtaccaggta SEQ ID NO: 90
Met Lys Glu Ala Val Val Tyr Gln Ile Phe Pro Asp Arg Phe Phe Asn Gly Asn Pro Ser Asn Asp Asn
Ser Lys Gln Gln Ala Arg Gly Ala Gln Pro Ile Glu His Arg Asp Trp Ser Asp Leu Pro Asp Asn Pro
Arg Leu Lys Gly Thr Ser Gly Tyr Asp Gly Asp Gly Glu Trp Ser Asn Asp Phe Phe Gly Gly Asp Ile
Ala Gly Ile Glu Gln Lys Leu Asp Tyr Leu Gln Ser Leu Gly Val Asn Thr Ile Tyr Leu Asn Pro Ile
Ala Asn Ala Pro Ser Asn His Lys Tyr Asp Ala Ser Asn Tyr Lys Glu Leu Asp Pro Met Phe Gly Ser
Pro Glu Glu Phe Gln Ser Phe Val Gln Ala Leu Ala Asn Arg Gly Met His Leu Ile Leu Asp Gly Val
Phe Asn His Val Ser Asp Asp Ser Ile Tyr Phe Asp Arg Tyr His Arg Tyr Pro Thr Val Gly Ala Tyr
Glu Tyr Trp Glu Ala Val Tyr Asp Leu Met Asn Glu Lys Gly Leu Ser Glu Glu Glu Ala Arg Lys Gln
Val Glu Glu Lys Phe Lys Gln Glu Gly Gln Thr Phe Ser Pro Tyr Gly Phe His Leu Trp Phe Asn Ile
Glu Asn Lys Lys Val Asn Gly His Tyr Gln Tyr Gln Ser Trp Trp Gly Tyr Asp Ser Leu Pro Glu Phe
Lys Ser Val Thr Gly Glu Lys Val Pro His Pro Ser Glu Leu Asn Asn Asp Ala Leu Ala Asn Tyr Ile
Phe Arg Glu Ser Asp Ser Val Ala Lys Ser Trp Ile Ala Leu Gly Ala Ser Gly Trp Arg Leu Asp Val
Ala Asn Glu Val Asp Pro Ala Phe Trp Arg Glu Phe Arg Gln Glu Leu Leu Gln Gly Ser Tyr Gly Arg
Gly Pro Thr Leu Lys Glu Gly Glu Gln Pro Leu Ile Leu Gly Glu Ile Trp Asp Asp Ala Ser Lys Tyr
Phe Leu Gly Asp Gln Tyr Asp Ser Val Met Asn Tyr Arg Phe Arg Gly Ala Val Leu Asp Phe Leu
Lys Asn Gly Asn Ala Glu Glu Ala Asp Lys Arg Leu Thr Ala Ile Arg Glu Asp Tyr Pro Ser Glu Ala
Phe Tyr Ala Leu Met Asn Leu Ile Gly Ser His Asp Thr Ala Arg Ala Val Phe Leu Leu Gly Asn Gly
Thr Asp Ser Ser Glu Arg Ala Glu Leu Asp Pro Asn Tyr Asn Glu Glu Leu Gly Lys Lys Arg Leu
Lys Leu Ala Val Ile Leu Gln Met Gly Tyr Pro Gly Ala Pro Thr Ile Tyr Tyr Gly Asp Glu Ala Gly
Val Thr Gly Ser Lys Asp Pro Asp Asn Arg Arg Thr Tyr Pro Trp Gly Lys Glu Asp Gln Asn Leu
Leu Ser His Tyr Gln Lys Val Gly His Ile Arg Gln His His Gln Ser Leu Leu Ala His Gly Asp Ile
Lys Thr Val Tyr Ala Gln Gly Asp Val Tyr Val Phe Ala Arg Gln Tyr Gly Arg Glu Ala Ala Leu Ile
Ala Ile Asn Arg Gly Asn Glu Asp Lys Thr Val Ala Leu Asp Val Ala Ser Leu Leu Pro Asn Gly Thr
Val Leu Thr Asp Glu Leu His Asp Gly Gly Glu Ala Thr Val Ala Gly Gly Thr Leu Thr Val Thr Ile
Pro Ala Leu Asp Gly Arg Met Met Phe Gly Thr Val Thr Ala Glu Met Pro Ala Ala Val Ser Asn Leu
Gln Ala Ser Ala Ser Asp Gly Cys Val Thr Leu Thr Trp Glu Gly Asn Ala Ser Arg Tyr Arg Ile Tyr
Glu Ser Thr Leu Lys Gly Ala Gly Tyr Thr Met Val Gln Glu Thr Glu Thr Thr Ser Ala Thr Ile Gly
Ser Leu Thr Asn Gly Thr Ala Tyr Tyr Phe Ala Val Ala Ala Val Asp Glu Asn Gly Asn Glu Ser Pro
Lys Val Glu Thr Asn Arg Val Val Pro His Tyr Pro Leu Thr Ser Asp Asn Val Gln Phe Val Thr Thr
Leu Ser Asp Ala Thr Leu Asp Leu Ser Lys Pro Gln Gln Val Asp Val His Val Asn Ile Asp Asn Val
Thr Ser Lys Gly Ala Ala Asp Gly Leu Gln Ala Val Leu Gln Val Lys Gly Pro His Asp Glu Thr Trp
Lys Glu Tyr Arg Ala Ala Tyr Gln Gly Gln Asp Gly Asp Ala Asn Val Phe Arg Ala Ala Phe Thr Pro
Leu Ala Ala Gly Thr Tyr Thr Tyr Arg Tyr Ala Leu Thr Thr Asn Leu Gly Glu Glu Trp Met Tyr Thr
Glu Glu Lys Gln Val Thr Phe Ala Ala Asp Asn Ser Asp Gln Ile Ala Pro Ala Asp Ala Ile Glu Leu
Arg Gln Pro Ala Val Glu Ser Gly Gln Val Asn Leu Ser Trp Thr Phe Val Gly Lys Lys Asp Gly Asp
Ala Tyr Leu Leu Ala Ile Glu Arg Asn Gly Asp Ile Val His Thr Thr Thr Ser Ile Gly Asp Ser Phe Thr
Asp Tyr Asp Val Glu Asn Gly Thr Glu Tyr Thr Tyr Val Val Lys Leu Tyr Asp Arg Ala Gly Asn
Val Val Ala Ser Asn Thr Val Lys Val Thr Pro Asp Ile Val Met Val Lys Val Ile Phe Lys Val Arg
Ala Pro Asp Tyr Thr Pro Leu Asp Ala Arg Ile Thr Ile Pro Asn Ser Leu Asn Gly Trp Asn Thr Gly
Ala Trp Glu Met Ser Arg Asn Gly Ala Val Thr Pro Asp Trp Gln Phe Thr Val Glu Val Gln Glu Gly
Glu Thr Ile Thr Tyr Lys Tyr Val Lys Gly Gly Ser Trp Asp Gln Glu Gly Leu Ala Asp His Thr Arg
Glu Asp Asp Asn Asp Asp Asp Val Ser Tyr Tyr Gly Tyr Gly Thr Ile Gly Thr Asp Leu Lys Val Thr
Val His Asn Glu Gly Asn Asn Thr Met Ile Val Gln Asp Arg Ile Leu Arg Trp Ile Asp Met Pro Val
Val Ile Glu Glu Val Gln Lys Gln Gly Ser Gln Val Thr Ile Lys Gly Asn Ala Ile Lys Asn Gly Val
Leu Thr Ile Asn Gly Glu Arg Val Pro Ile Asp Gly Arg Met Ala Phe Ser Tyr Thr Phe Ala Pro Ala
Ser His Gln Lys Glu Val Leu Ile His Ile Glu Pro Ser Ala Glu Ser Lys Thr Ala Ile Phe Asn Asn Asp

Figure 16GG

Gly Gly Ala Ile Ala Lys Asn Thr Lys Asp Tyr Val Leu Asn Leu Glu Thr Lys Gln Phe Lys Lys Leu Leu Glu Ser Thr Ser Arg Ala Ala Ala Gly Pro Ser Ile Phe His Pro Gly Gly Val Pro Gly

SEQ ID NO: 91 gtgctaacgtttcaccgcatcattcgaaaaggatggatgttcctgctcgcgttttgctcactgcctcgctgttctgcccaacaggacagcccgcca
aggctgccgcaccgtttaacggcaccatgatgcagtatttgaatggtacttgccggatgatggcacgttatggaccaaagtggccaatgaagc
caacaacttatccagccttggcatcaccgctctttggctgccgcccgcttataaaggaacaagccgcagcgacgtagggtacggagtatacga
cttgtatgacctcggcgaattcaatcaaaaagggaccgtccgcacaaaatacggaacaaaagctcaatatcttcaagccattcaagccgcccac
gccgctggaatgcaagtgtacgccgatgtcgtgttcgaccataaaggcggcgccgacggcacggaatgggtggacgccgtcgaagtcaatc
cgtccgaccgcaaccaagaaatctcgggcacctatcaaatccaagcatggacgaaatttgattttcccggggcggggcaacacctactccagctt
taagtggcgctggtaccattttgacggcgttgattgggacgaaagccgaaaattgagccgcatttacaaattccgcggcatcggcaaagcgtgg
gattgggaagtagacacggaaaacggaaactatgactacttaatgtatgccgacttggacatggaccatcctgaagtggttacggaactgaaaa
actgggggcaaatggtatgtcaacacaacgaacattgatgggttccggcttgatgccgtcaagcatattaagttcagtttttttcctgattggttgtcgt
atgtgcgttctcagactggcaagccgctatttaccgtcggggaatattggagctatgacatcaacaagttgcacaattacattacgaaaacaaacg
gaacgatgtctttgtttgatgccccgttacacaacaaattttataccgcttccaaatcaggggggcgcatttgatatgcgcacgttaatgaccaatact
ctcatgaaagatcaaccgacattggccgtcaccttcgttgataatcatgacaccgaacccggccaagcgctgcagtcatgggtcgacccatggt
tcaaaccgttggcttacgcctttattctaactcggcaggaaggatacccgtgcgtcttttatggtgactattatggcatcccacaatataacattcctt
cgctgaaaagcaaaatcgatccgctcctcatcgcgcgcagggattatgcttacggaacgcaacatgattatcttgatcactccgacatcatcggg
tggacaagggaaggcgtcactgaaaaaccaggatccggactggccgcactgatcaccgatgggccggggaggaagcaaatggatgtacgtt
ggcaaacaacacgccggaaaagtgttctatgaccttaccggcaaccggagtgacaccgtcaccatcaacagtgatggatggggagaattcaa
agtcaatggcggttcggtttcggtttggggttcctagaaaaacgaccgtctctaccatcgcttggccgatcacaacccgaccgtggactggtgaatt
cgtccgttggaccgaaccacggttggtggcatggccttga SEQ ID NO: 92
Val Leu Thr Phe His Arg Ile Ile Arg Lys Gly Trp Met Phe Leu Leu Ala Phe Leu Leu Thr Ala Ser Leu Phe Cys Pro Thr Gly Gln Pro Ala Lys Ala Ala Ala Pro Phe Asn Gly Thr Met Met Gln Tyr Phe Glu Trp Tyr Leu Pro Asp Asp Gly Thr Leu Trp Thr Lys Val Ala Asn Glu Ala Asn Asn Leu Ser Ser Leu Gly Ile Thr Ala Leu Trp Leu Pro Pro Ala Tyr Lys Gly Thr Ser Arg Ser Asp Val Gly Tyr Gly Val Tyr Asp Leu Tyr Asp Leu Gly Glu Phe Asn Gln Lys Gly Thr Val Arg Thr Lys Tyr Gly Thr Lys Ala Gln Tyr Leu Gln Ala Ile Gln Ala Ala His Ala Ala Gly Met Gln Val Tyr Ala Asp Val Val Phe Asp His Lys Gly Gly Ala Asp Gly Thr Glu Trp Val Asp Ala Val Glu Val Asn Pro Ser Asp Arg Asn Gln Glu Ile Ser Gly Thr Tyr Gln Ile Gln Ala Trp Thr Lys Phe Asp Phe Pro Gly Arg Gly Asn Thr Tyr Ser Ser Phe Lys Trp Arg Trp Tyr His Phe Asp Gly Val Asp Trp Asp Glu Ser Arg Lys Leu Ser Arg Ile Tyr Lys Phe Arg Gly Ile Gly Lys Ala Trp Asp Trp Glu Val Asp Thr Glu Asn Gly Asn Tyr Asp Tyr Leu Met Tyr Ala Asp Leu Asp Met Asp His Pro Glu Val Val Thr Glu Leu Lys Asn Trp Gly Lys Trp Tyr Val Asn Thr Thr Asn Ile Asp Gly Phe Arg Leu Asp Ala Val Lys His Ile Lys Phe Ser Phe Phe Pro Asp Trp Leu Ser Tyr Val Arg Ser Gln Thr Gly Lys Pro Leu Phe Thr Val Gly Glu Tyr Trp Ser Tyr Asp Ile Asn Lys Leu His Asn Tyr Ile Thr Lys Thr Asn Gly Thr Met Ser Leu Phe Asp Ala Pro Leu His Asn Lys Phe Tyr Thr Ala Ser Lys Ser Gly Gly Ala Phe Asp Met Arg Thr Leu Met Thr Asn Thr Leu Met Lys Asp Gln Pro Thr Leu Ala Val Thr Phe Val Asp Asn His Asp Thr Glu Pro Gly Gln Ala Leu Gln Ser Trp Val Asp Pro Trp Phe Lys Pro Leu Ala Tyr Ala Phe Ile Leu Thr Arg Gln Glu Gly Tyr Pro Cys Val Phe Tyr Gly Asp Tyr Tyr Gly Ile Pro Gln Tyr Asn Ile Pro Ser Leu Lys Ser Lys Ile Asp Pro Leu Leu Ile Ala Arg Arg Asp Tyr Ala Tyr Gly Thr Gln His Asp Tyr Leu Asp His Ser Asp Ile Ile Gly Trp Thr Arg Glu Gly Val Thr Glu Lys Pro Gly Ser Gly Leu Ala Ala Leu Ile Thr Asp Gly Pro Gly Gly Ser Lys Trp Met Tyr Val Gly Lys Gln His Ala Gly Lys Val Phe Tyr Asp Leu Thr Gly Asn Arg Ser Asp Thr Val Thr Ile Asn Ser Asp Gly Trp Gly Glu Phe Lys Val Asn Gly Gly Ser Val Ser Val Trp Val Pro Arg Lys Thr Thr Val Ser Thr Ile Ala Trp Pro Ile Thr Thr Arg Pro Trp Thr Gly Glu Phe Val Arg Trp Thr Glu Pro Arg Leu Val Ala Trp Pro

Figure 16HH

SEQ ID NO: 93
atgaaatcgtttgcattcatgcctatccttttttatgcaaacgatttcatcagtgaaagggaaggaggaggaaaaatggggaagaatatgagaaga
agattcacgtattttcaatcttcttattgttcgttcagctgttttcatttagtgcaaccgctagcgccaatggaacggtgaacagtagtcctgtggttaa
tggaaacgaagtcacgtttctatatggaggaacaggaaacgagcagtctgtgttactggcaggctccttaatgattggcagaaagatggtgaca
agaagattgcactaacaaaaggcgacaataacgtctggtctgtcacgcaaacacttcaagatgggacatatacgtataagtttgttgtagatggtc
aatggggtggcggatccgcttaacccgaatcaagtagacgacggttacggcggccgtaatagtgtcgttgttgtcgggacaccggtgcaacaag
aacggacagtgacgcttgttggtaacttacaagacgaattaggtcatacgagcgaatgggatccgaaagcgacagctacagtgatgaaaaagg
aagggaacgggttatatacgtttacaggtacacttccagccggaacgtacgagtataaaattgcgattaatggcagctgggacgaaaactatggt
gtcggcggccgcgatggcgggaatattaagctgctattaaatgaacaaacaacggttacattttattacaacgacagaacgcatgcgattgcgg
attcgacttggtatgcaccaattctaaaagaaaagcagccgcggctcgttggaacgatttaccagctattggttatgaaacagacgtgaacggtt
ggacgccgcaaacatcaacggcgttgttgtcagatgatgattttgattccatttatacgtttaaggcgcgtgtgccaaaagggacatatgaatataa
agtagttcttgggaatgattggacatatgaaaattatccacaagataatgccaaattaaatgtgcttgaagaaacgacaattaccttttctttaacgc
gaaaacgaaagtagtgtataccgattacaatccaagcggttcggatggtatcgtccaaaaagaccgtttgaagcataatacgtgggattcgttgta
tcgccaaccgtttggtgcggtgaaagctgggacagaagtgacccttcgtttatcagcgaaaaaaggtgatttgacaaaagcggatgtatatgtaa
aaaatacgacaaccggcacagcgaaactatattcgatgaaaaaagccggtgttcttggcgaagaagaatattgggaagcgacattcacaccgg
atgtgaaaggagtatacggttataaatttattgcggtagatgctggaacgaaagcagaatacggggaagatacacaagaagggcagtgggga
aaagcagtagataaaaatgcagagctgttccaattaacggtgtacgacccatcctaccaaacaccggattggatgaaagaagcagttgtatatca
aatttcctgatccaaag SEQ ID NO: 94
Met Lys Ser Phe Ala Phe Met Pro Ile Leu Phe Tyr Ala Asn Asp Phe Ile Ser Glu Arg Glu Gly Gly
Gly Lys Met Gly Lys Asn Met Arg Arg Arg Phe Thr Tyr Phe Ser Ile Phe Leu Leu Phe Val Gln Leu
Phe Ser Phe Ser Ala Thr Ala Ser Ala Asn Gly Thr Val Asn Ser Ser Pro Val Val Asn Gly Asn Glu
Val Thr Phe Leu Tyr Gly Gly Thr Gly Asn Glu Gln Ser Val Leu Leu Ala Gly Ser Phe Asn Asp Trp
Gln Lys Asp Gly Asp Lys Lys Ile Ala Leu Thr Lys Gly Asp Asn Asn Val Trp Ser Val Thr Gln Thr
Leu Gln Asp Gly Thr Tyr Thr Tyr Lys Phe Val Val Asp Gly Gln Trp Val Ala Asp Pro Leu Asn Pro
Asn Gln Val Asp Asp Gly Tyr Gly Gly Arg Asn Ser Val Val Val Val Gly Thr Pro Val Gln Gln Glu
Arg Thr Val Thr Leu Val Gly Asn Leu Gln Asp Glu Leu Gly His Thr Ser Glu Trp Asp Pro Lys Ala
Thr Ala Thr Val Met Lys Lys Gly Asn Gly Leu Tyr Thr Phe Thr Gly Thr Leu Pro Ala Gly Thr
Tyr Glu Tyr Lys Ile Ala Ile Asn Gly Ser Trp Asp Glu Asn Tyr Gly Val Gly Gly Arg Asp Gly Gly
Asn Ile Lys Leu Leu Leu Asn Glu Gln Thr Thr Val Thr Phe Tyr Tyr Asn Asp Arg Thr His Ala Ile
Ala Asp Ser Thr Trp Tyr Ala Pro Ile Leu Lys Glu Lys Gln Pro Arg Leu Val Gly Thr Ile Leu Pro
Ala Ile Gly Tyr Glu Thr Asp Val Asn Gly Trp Thr Pro Gln Thr Ser Thr Ala Leu Leu Ser Asp Asp
Asp Phe Asp Ser Ile Tyr Thr Phe Lys Ala Arg Val Pro Lys Gly Thr Tyr Glu Tyr Lys Val Val Leu
Gly Asn Asp Trp Thr Tyr Glu Asn Tyr Pro Gln Asp Asn Ala Lys Leu Asn Val Leu Glu Glu Thr
Thr Ile Thr Phe Phe Asn Ala Lys Thr Lys Val Val Tyr Thr Asp Tyr Asn Pro Ser Gly Ser Asp
Gly Ile Val Gln Lys Asp Arg Leu Lys His Asn Thr Trp Asp Ser Leu Tyr Arg Gln Pro Phe Gly Ala
Val Lys Ala Gly Thr Glu Val Thr Leu Arg Leu Ser Ala Lys Lys Gly Asp Leu Thr Lys Ala Asp Val
Tyr Val Lys Asn Thr Thr Thr Gly Thr Ala Lys Leu Tyr Ser Met Lys Lys Ala Gly Val Leu Gly Glu
Glu Glu Tyr Trp Glu Ala Thr Phe Thr Pro Asp Val Lys Gly Val Tyr Gly Tyr Lys Phe Ile Ala Val
Asp Ala Gly Thr Lys Ala Glu Tyr Gly Glu Asp Thr Gln Glu Gly Gln Trp Gly Lys Ala Val Asp Lys
Asn Ala Glu Leu Phe Gln Leu Thr Val Tyr Asp Pro Ser Tyr Gln Thr Pro Asp Trp Met Lys Glu Ala
Val Val Tyr Gln Ile Phe Pro Asp Pro Lys SEQ ID NO: 95
atgtatacactattcatccgttcatattttgatactgatggtgatggtgtaggagactttagtggagttgctgaaaaggtagattatctaaaatctcttg
gagtagatacagtctggttttaccatttaataaaagtaaatcttatcatggatatgatgttgaagattactatgatgtagaaccagattatggaacact
acaagatcttgataatatgataaaagttctaaatgaaaatggaataaaggtagtaatggatcttgttgttaatcatacgtcggatacacatccatggtt
tcttgatgcagttgaaaatactactaattctccatattggaactattacattatgagcttggatgagcctcaaaataagaatcattggcattataaggtt
aattcaaaaggacaaactgtgtggtattttggattgtttgattcatcaatgccggaccttaattacgacaaccctaaagtaatggatgaagtgaaaaa

Figure 16II aataatagatttttgggcagatatgggagtagatggatttagattagatgcagcaaaacattattatggatttgactggagcgatggaattgaacag
tcagcaagcgttgcaaaagagatagaagactatataaaagataaactaggggaaaatgcaatagttgtgagtgaggtttacgatggagattcaa
atgttcttttaaaatttgctccaatgcctgtgtttaattttagtttttatgtacaatttgagaggaaattttgaagggagagataacttaatttcagactctatt
agttgggttgattcctcgttgtataatttaaatgtttttcattttccatttattgatagtcatgatcttgacagatttatttctgagcttgtagatagtaaatatc
agggagatgtaatatctgccacaaaacaatatttgctagttaatgctttactactctcattaacaggcatgccaactatttactatggtgatgaaatag
gacttaggggatggaagtggcattcagaaccatgggatatacctgtgcgtgagccaatgcaatggtataaggatcaaaaagggaacggtcaaa
cttattggacaaaagagttttacgaaggtattactgaaggaagtgctaatgaagatggagcaatatacgatgatccagatgatggagtatctgtag
aagaacaagaaaatggatattctatttiaaactttttttaaagaatttatcaacttacgaaaagattatccggcacttgcttttggaagtactacgattga
gagagattggaaaaacttgtatgttttgaaaaagtcgtataacttccaggatgttcttgtattaattaaccttgatccaacgtattcaaatacatacgaa
gttccagaagggtataaatgggtgtggtatgcatttttttgatggtgacaactatgaatttggagcaaaagatgaaatgatttttacagaatacaagttg
gacgataaatccaaggcaaatttatatatttgtaaagtaa SEQ ID NO: 96
Met Tyr Thr Leu Phe Ile Arg Ser Tyr Phe Asp Thr Asp Gly Asp Gly Val Gly Asp Phe Ser Gly Val
Ala Glu Lys Val Asp Tyr Leu Lys Ser Leu Gly Val Asp Thr Val Trp Phe Leu Pro Phe Asn Lys Ser
Lys Ser Tyr His Gly Tyr Asp Val Glu Asp Tyr Tyr Asp Val Glu Pro Asp Tyr Gly Thr Leu Gln Asp
Leu Asp Asn Met Ile Lys Val Leu Asn Glu Asn Gly Ile Lys Val Val Met Asp Leu Val Val Asn His
Thr Ser Asp Thr His Pro Trp Phe Leu Asp Ala Val Glu Asn Thr Thr Asn Ser Pro Tyr Trp Asn Tyr
Tyr Ile Met Ser Leu Asp Glu Pro Gln Asn Lys Asn His Trp His Tyr Lys Val Asn Ser Lys Gly Gln
Thr Val Trp Tyr Phe Gly Leu Phe Asp Ser Ser Met Pro Asp Leu Asn Tyr Asp Asn Pro Lys Val Met
Asp Glu Val Lys Lys Ile Ile Asp Phe Trp Ala Asp Met Gly Val Asp Gly Phe Arg Leu Asp Ala Ala
Lys His Tyr Tyr Gly Phe Asp Trp Ser Asp Gly Ile Glu Gln Ser Ala Ser Val Ala Lys Glu Ile Glu
Asp Tyr Ile Lys Asp Lys Leu Gly Glu Asn Ala Ile Val Val Ser Glu Val Tyr Asp Gly Asp Ser Asn
Val Leu Leu Lys Phe Ala Pro Met Pro Val Phe Asn Phe Ser Phe Met Tyr Asn Leu Arg Gly Asn
Phe Glu Gly Arg Asp Asn Leu Ile Ser Asp Ser Ile Ser Trp Val Asp Ser Ser Leu Tyr Asn Leu Asn
Val Phe His Phe Pro Phe Ile Asp Ser His Asp Leu Asp Arg Phe Ile Ser Glu Leu Val Asp Ser Lys
Tyr Gln Gly Asp Val Ile Ser Ala Thr Lys Gln Tyr Leu Leu Val Asn Ala Leu Leu Leu Ser Leu Thr
Gly Met Pro Thr Ile Tyr Tyr Gly Asp Glu Ile Gly Leu Arg Gly Trp Lys Trp His Ser Glu Pro Trp
Asp Ile Pro Val Arg Glu Pro Met Gln Trp Tyr Lys Asp Gln Lys Gly Asn Gly Gln Thr Tyr Trp Thr
Lys Glu Phe Tyr Glu Gly Ile Thr Glu Gly Ser Ala Asn Glu Asp Gly Ala Ile Tyr Asp Asp Pro Asp
Asp Gly Val Ser Val Glu Glu Gln Glu Asn Gly Tyr Ser Ile Leu Asn Phe Phe Lys Glu Phe Ile Asn
Leu Arg Lys Asp Tyr Pro Ala Leu Ala Phe Gly Ser Thr Thr Ile Glu Arg Asp Trp Lys Asn Leu Tyr
Val Leu Lys Lys Ser Tyr Asn Phe Gln Asp Val Leu Val Leu Ile Asn Leu Asp Pro Thr Tyr Ser Asn
Thr Tyr Glu Val Pro Glu Gly Tyr Lys Trp Val Trp Tyr Ala Phe Phe Asp Gly Asp Asn Tyr Glu Phe
Gly Ala Lys Asp Glu Met Ile Leu Gln Asn Thr Ser Trp Thr Ile Asn Pro Arg Gln Ile Tyr Ile Phe Val
Lys SEQ ID NO: 97
atgaggaagaagatgtcgcattcaagatttacttttcttttgatcttagcactttttattttcttctccggttgtatttcagaagttaaaagcgaaagccag
ctactaaattcaaagcaaaaggtccttgtaaaagtaaatgttaatacgccatttattgagaatgctactactaatacgtggagtgtttcaaaagaatct
tttattgattatcttagtaaagtgattattactgttaaggatgtaaatgatcagattgtatttactaaggaaacaacgaacaaaacaaatatttattttgaa
attgaacttcttcctggaacttatacatttgaggtaaaaggatatgaggaagatttagttatattttcaggggaaaaagttaatcagatcatagatgag
aaaaataatattgttaatgtcgaaacttttttttgttaatggaatagttaggacaataattgaagttgacgatattatttataaaaattatgatattacatcgg
caacgttgatcttcaaaaaagatacagcacaagaagattatgaagaggtacctgtaacacttacaggtacttccactttaattaataaagaattatat
cctggtatgtggactgtaaaatttgaagttgatcttaaatcaaaggatgcaagtatgttaccagaaaaagttcatcttgaaaatgaatttagcataga
agtgcttccagcaaagacaaaaagtttaacatttaatgtagtctttgatacagagagttaatgaaccgaaattagtagttgtatttccgcaaattgagtt
gccttttgtggatcctgtaacaaatttaagtggagagataaatgaattagaagggaatctttcaatgaattgggactattcagatccaaatgcagaat
tttatgtgtataaagaattagaggaacaaggagaatatttgtatgaatttgttggaaaaacacgcgagaaaagttatacaatagaaaattttaccaag
caagaattcgataaatttagtggaatcgctattaatgttatgccaacggtaaagagagtggattagttgttctaaaaaaagaaaatattaaacttata
gatttagaaagtgttgacagtataagtgctacttataacgttgatacgaatgagcttaagttggattggaattataccaattcaagtgttacttttgaag ttttgaaaaaaggtataaatagcaatgaatacgaaataatttctcaactaacacaaaattcttttcaacagaattcacaggcaggcaattttgggatc
ttgagaaaattgcgattagagtagttgctaatggatttgaaagtaagattaatgagatttcaagagatgatataactataacatcattgaatcttcctct
tacatcgtctactatgtatacactattcatccgttcatattttgatactgatggtgatggtgtaggagacttagtggagttgctgaaaaggtagattatc
taaaatctcttggagtagatacagtctggtttttaccattaataaaagtaaatcttatcatggatatgatgttgaagattactatgatgtagaaccagat
tatggaacactacaagatcttgataatatgataaaagttctaaatgaaaatggaataaaggtagtaatggatcttgttgttaatcatacgtcggatac
acatccatggtttcttgatgcagttgaaaatactactaattctccatattggaactattacattatgagcttggatgagcctcaaaataagaatcattgg
cattataaggttaattcaaaaggacaaactgtgtggtattttggattgtttgattcatcaatgccggaccttaattacgacaaccctaaagtaatggat
gaagtgaaaaaaataatagatttttgggcagatatggggagtagatggatttagattagatgcagcaaaacattattatggatttgactggagcgatg
gaattgaacagtcagcaagcgttgcaaaagagatagaagactatataaaagataaactaggggaaaatgcaatagttgtgagtgaggtttacga
tggagattcaaatgttcttttaaaatttgctccaatgcctgtgtttaatttagttttatgtacaatttgagaggaaattttgaagggagagataacttaatt
tcagactctattagttgggttgattcctcgttgtataatttaaatgtttttcattttccatttattgatagtcatgatcttgacagatttatttctgagcttgtag
atagtaaatatcagggagatgtaatatctgccacaaaacaatatttgctagttaatgctttactactctcattaacaggcatgccaactatttactatgg
tgatgaaataggacttaggggatggaagtggcattcagaaccatgggatatacctgtgcgtgagccaatgcaatggtataaggatcaaaaagg
gaacggtcaaacttattggacaaaagagtttacgaaggtattactgaaggaagtgctaatgaagatggagcaatatacgatgatccagatgatg
gagtatctgtagaagaacaagaaaatggatattctattttaaactttttttaaagaatttatcaacttacgaaaagattatccggcacttgcttttggaagt
actacgattgagagagattggaaaaacttgtatgttttgaaaaagtcgtataacttccaggatgttcttgtattaattaaccttgatccaacgtattcaa
atacgaagttccagaagggtataaatgggtgtggtatgcatttttgatggtgacaactatgaatttggagcaaaagatgaaatgattttacag
aatacaagttggacgataaatccaaggcaaatttatatatttgtaaagtaa SEQ ID NO: 98
Met Arg Lys Lys Met Ser His Ser Arg Phe Thr Phe Leu Leu Ile Leu Ala Leu Phe Ile Phe Phe Ser
Gly Cys Ile Ser Glu Val Lys Ser Glu Ser Gln Leu Leu Asn Ser Lys Gln Lys Val Leu Val Lys Val
Asn Val Asn Thr Pro Phe Ile Glu Asn Ala Thr Thr Asn Thr Trp Ser Val Ser Lys Glu Ser Phe Ile
Asp Tyr Leu Ser Lys Val Ile Ile Thr Val Lys Asp Val Asn Asp Gln Ile Val Phe Thr Lys Glu Thr
Thr Asn Lys Thr Asn Ile Tyr Phe Glu Ile Glu Leu Leu Pro Gly Thr Tyr Thr Phe Glu Val Lys Gly
Tyr Glu Glu Asp Leu Val Ile Phe Ser Gly Glu Lys Val Asn Gln Ile Ile Asp Glu Lys Asn Asn Ile
Val Asn Val Glu Thr Phe Phe Val Asn Gly Ile Val Arg Thr Ile Ile Glu Val Asp Asp Ile Ile Tyr Lys
Asn Tyr Asp Ile Thr Ser Ala Thr Leu Ile Phe Lys Lys Asp Thr Ala Gln Glu Asp Tyr Glu Glu Val
Pro Val Thr Leu Thr Gly Thr Ser Thr Leu Ile Asn Lys Glu Leu Tyr Pro Gly Met Trp Thr Val Lys
Phe Glu Val Asp Leu Lys Ser Lys Asp Ala Ser Met Leu Pro Glu Lys Val His Leu Glu Asn Glu Phe
Ser Ile Glu Val Leu Pro Ala Lys Thr Lys Ser Leu Thr Phe Asn Val Val Phe Asp Thr Glu Val Asn
Glu Pro Lys Leu Val Val Val Phe Pro Gln Ile Glu Leu Pro Phe Val Asp Pro Val Thr Asn Leu Ser
Gly Glu Ile Asn Glu Leu Glu Gly Asn Leu Ser Met Asn Trp Asp Tyr Ser Asp Pro Asn Ala Glu Phe
Tyr Val Tyr Lys Glu Leu Glu Glu Gln Gly Glu Tyr Leu Tyr Glu Phe Val Gly Lys Thr Arg Glu Lys
Ser Tyr Thr Ile Glu Asn Phe Thr Lys Gln Glu Phe Asp Lys Phe Ser Gly Ile Ala Ile Asn Val Tyr
Ala Asn Gly Lys Glu Ser Gly Leu Val Val Leu Lys Lys Glu Asn Ile Lys Leu Ile Asp Leu Glu Ser
Val Asp Ser Ile Ser Ala Thr Tyr Asn Val Asp Thr Asn Glu Leu Lys Leu Asp Trp Asn Tyr Thr Asn
Ser Ser Val Thr Phe Glu Val Leu Lys Lys Gly Ile Asn Ser Asn Glu Tyr Glu Ile Ile Ser Gln Leu Thr
Gln Asn Ser Phe Ser Thr Glu Phe Thr Gly Arg Gln Phe Trp Asp Leu Glu Lys Ile Ala Ile Arg Val
Val Ala Asn Gly Phe Glu Ser Lys Ile Asn Glu Ile Ser Arg Asp Asp Ile Thr Ile Thr Ser Leu Asn Leu
Pro Leu Thr Ser Ser Thr Met Tyr Thr Leu Phe Ile Arg Ser Tyr Phe Asp Thr Asp Gly Asp Gly Val
Gly Asp Phe Ser Gly Val Ala Glu Lys Val Asp Tyr Leu Lys Ser Leu Gly Val Asp Thr Val Trp Phe
Leu Pro Phe Asn Lys Ser Lys Ser Tyr His Gly Tyr Asp Val Glu Asp Tyr Tyr Asp Val Glu Pro Asp
Tyr Gly Thr Leu Gln Asp Leu Asp Asn Met Ile Lys Val Leu Asn Glu Asn Gly Ile Lys Val Val Met
Asp Leu Val Val Asn His Thr Ser Asp Thr His Pro Trp Phe Leu Asp Ala Val Glu Asn Thr Thr Asn
Ser Pro Tyr Trp Asn Tyr Tyr Ile Met Ser Leu Asp Glu Pro Gln Asn Lys Asn His Trp His Tyr Lys
Val Asn Ser Lys Gly Gln Thr Val Trp Tyr Phe Gly Leu Phe Asp Ser Ser Met Pro Asp Leu Asn Tyr
Asp Asn Pro Lys Val Met Asp Glu Val Lys Lys Ile Ile Asp Phe Trp Ala Asp Met Gly Val Asp Gly
Phe Arg Leu Asp Ala Ala Lys His Tyr Tyr Gly Phe Asp Trp Ser Asp Gly Ile Glu Gln Ser Ala Ser
Val Ala Lys Glu Ile Glu Asp Tyr Ile Lys Asp Lys Leu Gly Glu Asn Ala Ile Val Val Ser Glu Val

Figure 16KK

Tyr Asp Gly Asp Ser Asn Val Leu Leu Lys Phe Ala Pro Met Pro Val Phe Asn Phe Ser Phe Met Tyr
Asn Leu Arg Gly Asn Phe Glu Gly Arg Asp Asn Leu Ile Ser Asp Ser Ile Ser Trp Val Asp Ser Ser
Leu Tyr Asn Leu Asn Val Phe His Phe Pro Phe Ile Asp Ser His Asp Leu Asp Arg Phe Ile Ser Glu
Leu Val Asp Ser Lys Tyr Gln Gly Asp Val Ile Ser Ala Thr Lys Gln Tyr Leu Leu Val Asn Ala Leu
Leu Leu Ser Leu Thr Gly Met Pro Thr Ile Tyr Tyr Gly Asp Glu Ile Gly Leu Arg Gly Trp Lys Trp
His Ser Glu Pro Trp Asp Ile Pro Val Arg Glu Pro Met Gln Trp Tyr Lys Asp Gln Lys Gly Asn Gly
Gln Thr Tyr Trp Thr Lys Glu Phe Tyr Glu Gly Ile Thr Glu Gly Ser Ala Asn Glu Asp Gly Ala Ile
Tyr Asp Asp Pro Asp Asp Gly Val Ser Val Glu Glu Gln Glu Asn Gly Tyr Ser Ile Leu Asn Phe Phe
Lys Glu Phe Ile Asn Leu Arg Lys Asp Tyr Pro Ala Leu Ala Phe Gly Ser Thr Thr Ile Glu Arg Asp
Trp Lys Asn Leu Tyr Val Leu Lys Lys Ser Tyr Asn Phe Gln Asp Val Leu Val Leu Ile Asn Leu Asp
Pro Thr Tyr Ser Asn Thr Tyr Glu Val Pro Glu Gly Tyr Lys Trp Val Trp Tyr Ala Phe Phe Asp Gly
Asp Asn Tyr Glu Phe Gly Ala Lys Asp Glu Met Ile Leu Gln Asn Thr Ser Trp Thr Ile Asn Pro Arg
Gln Ile Tyr Ile Phe Val Lys

SEQ ID NO: 99
atgtacacactcttcatccgctcttttacgatacaaacaacgacggtgtaggtgactacaacggtgttgcccaaaaagtagactatctcaaaacg
cttggagtggatacagtttggttcttgccgttcaacaaagcaaaatcgtaccacggttacgatgttgaagactactacgatgtagaacctgactatg
gaacatacgcacaacttgaaaatatgataaagacactcaatcagaacggaattcgtgttgttatggacttggttgtgaaccacacttccgatacac
actcgtggtttctggatgccgttgagaacacaacgaattcgaaatattggagctactacataatgacacttgaaaatagagacggttggaatcact
ggcattggaagataaactcaaaagggcaaaaagtttactacttcggactgtttgactcatcaatgcccgatttgaatttcgacaatccacaagtgat
gaacgaaatcaagagaataatcgatttctggataacagttggtgtggatggtttcagacttgatgcaccaaagcactacaaaaggctgggattggg
acgacggcatttcaggttcagcagcaatcgcgagggaaatagaaagttacatcaggagcaagttaggaaacgatgcgatagttgtcggggaa
gtgtacgatggaaatccatcggttctttcacaatttgcaccgatgccggccgttcaacttcacattcatgtatgaataacaggcaaccatgagggg
aaagataacctgctgggagaaacaatttcatgggttaatggagcgagttattatctcaacgtaaaacatttcccgttcatagacaatcacgatttga
acagatggatatcgatacttatcgaccaaaagtatagtggaaacacacaagttggtacgaagcagtatattttaacaaatgcgctcttgctttcctta
aacggtatgcctgttatttattatgggaatgaaataggcttgagaggatggaaatggggacaagacccgtgggatttgccggtgagagagccga
tgcagtggtacgcaagtcaaagtggagctgggcagacatggtggacaaagcctgtctaccagcaaaaaggaatcacatttggaaatgcaaac
gtcgatggtgcgatgtacgatgatccaaatgatggggttcagtagaagagcagatgaatggttacacgataaataacttctttaaacaattcataa
ccctgaggaagacatatccggctctatcgaaaggttcgataacgatagaacgcgactggaagaacctgtacgttatcaaacgagtctacggaa
atcaggaagtgcttgtattgataaacttagacccaacttggccgaacaattacacgttaccaggtggatacaggtgggtctggtatgcgttctttaa
tgggagtttgtttgaatttggcaataaaaacgaatcaccactgagccaagataccaactggacagtcaatccaaggcaagtgtatgtgtttgtgaa
ggactaa SEQ ID NO: 100
Met Tyr Thr Leu Phe Ile Arg Ser Phe Tyr Asp Thr Asn Asn Asp Gly Val Gly Asp Tyr Asn Gly Val
Ala Gln Lys Val Asp Tyr Leu Lys Thr Leu Gly Val Asp Thr Val Trp Phe Leu Pro Phe Asn Lys Ala
Lys Ser Tyr His Gly Tyr Asp Val Glu Asp Tyr Tyr Asp Val Glu Pro Asp Tyr Gly Thr Tyr Ala Gln
Leu Glu Asn Met Ile Lys Thr Leu Asn Gln Asn Gly Ile Arg Val Val Met Asp Leu Val Val Asn His
Thr Ser Asp Thr His Ser Trp Phe Leu Asp Ala Val Glu Asn Thr Thr Asn Ser Lys Tyr Trp Ser Tyr
Tyr Ile Met Thr Leu Glu Asn Arg Asp Gly Trp Asn His Trp His Trp Lys Ile Asn Ser Lys Gly Gln
Lys Val Tyr Tyr Phe Gly Leu Phe Asp Ser Ser Met Pro Asp Leu Asn Phe Asp Asn Pro Gln Val
Met Asn Glu Ile Lys Arg Ile Ile Asp Phe Trp Ile Thr Val Gly Val Asp Gly Phe Arg Leu Asp Ala
Pro Lys His Tyr Lys Gly Trp Asp Trp Asp Asp Gly Ile Ser Gly Ser Ala Ala Ile Ala Arg Glu Ile Glu
Ser Tyr Ile Arg Ser Lys Leu Gly Asn Asp Ala Ile Val Val Gly Glu Val Tyr Asp Gly Asn Pro Ser
Val Leu Ser Gln Phe Ala Pro Met Pro Ala Phe Asn Phe Thr Phe Met Tyr Gly Ile Thr Gly Asn His
Glu Gly Lys Asp Asn Leu Leu Gly Glu Thr Ile Ser Trp Val Asn Gly Ala Ser Tyr Tyr Leu Asn Val
Lys His Phe Pro Phe Ile Asp Asn His Asp Leu Asn Arg Trp Ile Ser Ile Leu Ile Asp Gln Lys Tyr Ser
Gly Asn Thr Gln Val Gly Thr Lys Gln Tyr Ile Leu Thr Asn Ala Leu Leu Leu Ser Leu Asn Gly Met
Pro Val Ile Tyr Tyr Gly Asn Glu Ile Gly Leu Arg Gly Trp Lys Trp Gly Gln Asp Pro Trp Asp Leu
Pro Val Arg Glu Pro Met Gln Trp Tyr Ala Ser Gln Ser Gly Ala Gly Gln Thr Trp Trp Thr Lys Pro

Figure 16LL

Val Tyr Gln Gln Lys Gly Ile Thr Phe Gly Asn Ala Asn Val Asp Gly Ala Met Tyr Asp Asp Pro Asn
Asp Gly Val Ser Val Glu Glu Gln Met Asn Gly Tyr Thr Ile Asn Asn Phe Phe Lys Gln Phe Ile Thr
Leu Arg Lys Thr Tyr Pro Ala Leu Ser Lys Gly Ser Ile Thr Ile Glu Arg Asp Trp Lys Asn Leu Tyr
Val Ile Lys Arg Val Tyr Gly Asn Gln Glu Val Leu Val Leu Ile Asn Leu Asp Pro Thr Trp Pro Asn
Asn Tyr Thr Leu Pro Gly Gly Tyr Arg Trp Val Trp Tyr Ala Phe Phe Asn Gly Ser Leu Phe Glu Phe
Gly Asn Lys Asn Glu Ser Pro Leu Ser Gln Asp Thr Asn Trp Thr Val Asn Pro Arg Gln Val Tyr Val
Phe Val Lys Asp

SEQ ID NO: 101
ttgcgattctttccaaagttaatatccccttttccgcaaaacaccagagagtggcagcgaagcgcagtatcaagagacactgaacaattacaaag
gaaagtaataatgatcaatttgaaaaaaaacaccattagcgccctggtcgcaggtatggtattaggctttgcatccaacgcaatggcggttcctag
aaccgcttttgtacacctctttgaatggaaatgggaagatgttgcacaggagtgtgaaacatttctcggacctaaaggctttgccgcagtgcaagt
ctctccgccaactaaatctcacaacacggatgcatggtggggccgttatcaacccgttagttatgcttttgaaggacgcagcggtaatcgcagcc
aatttaaaaatatggtgcaacgttgtaaagctgtaggcgtcgatatatacgtagatgcagtgattaaccacatggcagcctacgacagaaatttcc
ctgatgtacccatatagcagtaatgactttaactcctgtacaggagatattgactataataaccgttggcaaacacagcattgtgatttagtcggtctta
atgatctaaaaacaggatctgactacgtccgccaaaaaatagcggattatatgaacgacgcaatcagtatgggtgtagctggtttccgtattgatg
cagccaaacatataccagcaggtgatatagctgccattaaaggtaaattaaatggtaatccatacatcttccaagaggtaattggtgcatccggcg
aacctgttcgaccgactgaatacacctttatcggtggtgtcacggaatttcaatttgctcgaaaattgggtccagccttccgcaatagtaatattgctt
ggttaaaagacattggcagtcaaatggaattatccagtgctgatgccgtaacatttgtaacgaatcatgatgaagagcgtcataacccgaatggtc
ctatttggcacggcgttcaaggtaatggttatgcattagcaaatattttcaccttagcttaccccttacggctatccaaaaatcatgtcaggatacttctt
ccacggtgactttaacgcagctccaccaagcagtggtatacacacaggaaatgcgtgtggtttgatggcggagactgggtatgcgaacacaa
atggcgcggtattgctaacatggttgccttccgcaactatacagcaagcgaatggcgtatcagtaattggtggcaaaacagtaacgaccaaattg
ctttggtcgcggtggtttaggttttgttgttattaataaacgtgctaatggtagcattaatcaaagttttgatacgggaatgcctgatggccaatactgt
aacataatagaagctaactttgatgaaagcaccggccaatgtagtgcagctacagattccaacggtcaagccgttattaccgtcagtggtgggca
agctaactttaatgtagcaggcgatcatgctgctgcaattcatgttggcgcaaaaattggtgatcaatgtagtggtgatgattgcccatgtacagga
tccgattgtaataatgatcctaaacctgattttgcagtaccagcaacatcaatttgtacatcagaaaatttacctacgctatattactggggagcaca
gcctacagatagcttagcgaatgcagcttggccaggtgtcgcaatgcaaacaaatggcgactttaagtgtcatgatttaggtgtcgaactaacca
aaattaacgccatctttagtgacaatggtgcaaataaaacagctgatctaactgttactggtgcaggttgttataaagacgggacttggagcacctt
acaaaattgtggctttgaaattaccggtgcacaaaccaatccagtcggtggcgacgaagtctggtacttccgaggtactgctaatgactggggta
aagcacaattagattatgacgcaactagcggtttgtattacacaatacaaagctttaatggtgaagaagcacctgcgcgttttaaaattgataatggt
agttggactgaagcttatccaacagctgattaccaagttacagataacaattcataccgcattaactttaatagcgatagcaaagcgattacagtaa
acgcacaataa SEQ ID NO: 102
Met Arg Phe Phe Pro Lys Leu Ile Ser Pro Phe Pro Gln Asn Thr Arg Glu Trp Gln Arg Ser Ala Val
Ser Arg Asp Thr Glu Gln Leu Gln Arg Lys Val Ile Met Ile Asn Leu Lys Lys Asn Thr Ile Ser Ala
Leu Val Ala Gly Met Val Leu Gly Phe Ala Ser Asn Ala Met Ala Val Pro Arg Thr Ala Phe Val His
Leu Phe Glu Trp Lys Trp Glu Asp Val Ala Gln Glu Cys Glu Thr Phe Leu Gly Pro Lys Gly Phe Ala
Ala Val Gln Val Ser Pro Pro Thr Lys Ser His Asn Thr Asp Ala Trp Trp Gly Arg Tyr Gln Pro Val
Ser Tyr Ala Phe Glu Gly Arg Ser Gly Asn Arg Ser Gln Phe Lys Asn Met Val Gln Arg Cys Lys Ala
Val Gly Val Asp Ile Tyr Val Asp Ala Val Ile Asn His Met Ala Ala Tyr Asp Arg Asn Phe Pro Asp
Val Pro Tyr Ser Ser Asn Asp Phe Asn Ser Cys Thr Gly Asp Ile Asp Tyr Asn Asn Arg Trp Gln Thr
Gln His Cys Asp Leu Val Gly Leu Asn Asp Leu Lys Thr Gly Ser Asp Tyr Val Arg Gln Lys Ile Ala
Asp Tyr Met Asn Asp Ala Ile Ser Met Gly Val Ala Gly Phe Arg Ile Asp Ala Ala Lys His Ile Pro
Ala Gly Asp Ile Ala Ala Ile Lys Gly Lys Leu Asn Gly Asn Pro Tyr Ile Phe Gln Glu Val Ile Gly Ala
Ser Gly Glu Pro Val Arg Pro Thr Glu Tyr Thr Phe Ile Gly Gly Val Thr Glu Phe Gln Phe Ala Arg
Lys Leu Gly Pro Ala Phe Arg Asn Ser Asn Ile Ala Trp Leu Lys Asp Ile Gly Ser Gln Met Glu Leu
Ser Ser Ala Asp Ala Val Thr Phe Val Thr Asn His Asp Glu Glu Arg His Asn Pro Asn Gly Pro Ile
Trp His Gly Val Gln Gly Asn Gly Tyr Ala Leu Ala Asn Ile Phe Thr Leu Ala Tyr Pro Tyr Gly Tyr
Pro Lys Ile Met Ser Gly Tyr Phe Phe His Gly Asp Phe Asn Ala Ala Pro Pro Ser Ser Gly Ile His Thr

Figure 16MM

Gly Asn Ala Cys Gly Phe Asp Gly Gly Asp Trp Val Cys Glu His Lys Trp Arg Gly Ile Ala Asn Met
Val Ala Phe Arg Asn Tyr Thr Ala Ser Glu Trp Arg Ile Ser Asn Trp Trp Gln Asn Ser Asn Asp Gln
Ile Ala Phe Gly Arg Gly Gly Leu Gly Phe Val Val Ile Asn Lys Arg Ala Asn Gly Ser Ile Asn Gln
Ser Phe Asp Thr Gly Met Pro Asp Gly Gln Tyr Cys Asn Ile Ile Glu Ala Asn Phe Asp Glu Ser Thr
Gly Gln Cys Ser Ala Ala Thr Asp Ser Asn Gly Gln Ala Val Ile Thr Val Ser Gly Gly Gln Ala Asn
Phe Asn Val Ala Gly Asp His Ala Ala Ala Ile His Val Gly Ala Lys Ile Gly Asp Gln Cys Ser Gly
Asp Asp Cys Pro Cys Thr Gly Ser Asp Cys Asn Asn Asp Pro Lys Pro Asp Phe Ala Val Pro Ala
Thr Ser Ile Cys Thr Ser Glu Asn Leu Pro Thr Leu Tyr Tyr Trp Gly Ala Gln Pro Thr Asp Ser Leu
Ala Asn Ala Ala Trp Pro Gly Val Ala Met Gln Thr Asn Gly Asp Phe Lys Cys His Asp Leu Gly Val
Glu Leu Thr Lys Ile Asn Ala Ile Phe Ser Asp Asn Gly Ala Asn Lys Thr Ala Asp Leu Thr Val Thr
Gly Ala Gly Cys Tyr Lys Asp Gly Thr Trp Ser Thr Leu Gln Asn Cys Gly Phe Glu Ile Thr Gly Ala
Gln Thr Asn Pro Val Gly Gly Asp Glu Val Trp Tyr Phe Arg Gly Thr Ala Asn Asp Trp Gly Lys Ala
Gln Leu Asp Tyr Asp Ala Thr Ser Gly Leu Tyr Tyr Thr Ile Gln Ser Phe Asn Gly Glu Glu Ala Pro
Ala Arg Phe Lys Ile Asp Asn Gly Ser Trp Thr Glu Ala Tyr Pro Thr Ala Asp Tyr Gln Val Thr Asp
Asn Asn Ser Tyr Arg Ile Asn Phe Asn Ser Asp Ser Lys Ala Ile Thr Val Asn Ala Gln

SEQ ID NO: 103
gtgctaacgtttcaccgcatcattcgaaaaggatggatgttcctgctcgcgttttttgctcactgcctcgctgttctgcccaacaggacagcccgcca
aggctgccgcaccgtttaacggcaccatgatgcagtattttgaatggtacttgccggatgatggcacgttatggaccaaagtggccaatgaagc
caacaacttatccagccttggcatcaccgctcttggctgccgcccgcttacaaaggaacaagccgcagcgacgtagggtacggagtatacga
cttgtatgacctcggcgaattcaatcaaaaagggaccgtccgcacaaaatacggaacaaaagctcaatatcttcaagccattcaagccgcccac
gccgctggaatgcaagtgtacgccgatgtcgtgttcgaccataaaggcggcgccgacggcacggaatgggtggacgccgtcgaagtcaatc
cgtccgaccgcaaccaagaaatctcgggcacctatcaaatccaagcatggacgaaatttgattttcccgggcggggcaacacctactccagctt
taagtggcgctggtaccattttgacggcgttgattgggacgaaagccgaaaattgagccgcatttacaaattccgcggcatcggcaaagcgtgg
gattgggaagtagacacggaaaacggaaactatgactacttaatgtatgccgaccttgatatgatcatcccgaagtcgtgaccgagctgaaaa
actgggggaatggtatgtcaacacaacgaacattgatgggttccggcttgatgccgtcaagcatattaagttcagttttttcctgattggttgtcgt
atgtgcgttctcagactggcaagccgctatttaccgtcggggaatattggagctatgacatcaacaagttgcacaattacattacgaaaacaaacg
gaacgatgtctttgtttgatgccccgttacacaacaaattttataccgcttccaaatcagggggcgcatttgatatgcgcacgttaatgaccaatact
ctcatgaaagatcaaccgacattggccgtcaccttcgttgataatcatgacaccgaacccggccaagcgctgcagtcatgggtcgacccatggt
tcaaaccgttggcttacgcctttattctaactcggcaggaaggataccgtgcgtcttttatggtgactattatggcattccacaatataacattccttc
gctgaaaagcaaaatcgatccgctcctcatcgcgcgcagggattatgcttacggaacgcaacatgattatcttgatcactccgacatcatcgggt
ggacaagggaaggggtcactgaaaaaccaggatccgggctggccgcactgatcaccgatgggccgggaggaagcaaatggatgtacgttg
gcaaacaacacgctggaaaagtgttctatgaccttaccggcaaccggagtgacaccgtcaccatcaacagtgatggatgggggaattcaaa
gtcaatggcggttcggtttcggtttgggttcctagaaaaacgaccgtttctaccatcgctcggccgatcacaacccgaccgtggactggtgaattc
gtccgttggaccgaaccacggttggtggcatggccttga SEQ ID NO: 104
Val Leu Thr Phe His Arg Ile Ile Arg Lys Gly Trp Met Phe Leu Leu Ala Phe Leu Leu Thr Ala Ser
Leu Phe Cys Pro Thr Gly Gln Pro Ala Lys Ala Ala Ala Pro Phe Asn Gly Thr Met Met Gln Tyr Phe
Glu Trp Tyr Leu Pro Asp Asp Gly Thr Leu Trp Thr Lys Val Ala Asn Glu Ala Asn Asn Leu Ser Ser
Leu Gly Ile Thr Ala Leu Trp Leu Pro Pro Ala Tyr Lys Gly Thr Ser Arg Ser Asp Val Gly Tyr Gly
Val Tyr Asp Leu Tyr Asp Leu Gly Glu Phe Asn Gln Lys Gly Thr Val Arg Thr Lys Tyr Gly Thr
Lys Ala Gln Tyr Leu Gln Ala Ile Gln Ala Ala His Ala Ala Gly Met Gln Val Tyr Ala Asp Val Val
Phe Asp His Lys Gly Gly Ala Asp Gly Thr Glu Trp Val Asp Ala Val Glu Val Asn Pro Ser Asp Arg
Asn Gln Glu Ile Ser Gly Thr Tyr Gln Ile Gln Ala Trp Thr Lys Phe Asp Phe Pro Gly Arg Gly Asn
Thr Tyr Ser Ser Phe Lys Trp Arg Trp Tyr His Phe Asp Gly Val Asp Trp Asp Glu Ser Arg Lys Leu
Ser Arg Ile Tyr Lys Phe Arg Gly Ile Gly Lys Ala Trp Asp Trp Glu Val Asp Thr Glu Asn Gly Asn
Tyr Asp Tyr Leu Met Tyr Ala Asp Leu Asp Met Asp His Pro Glu Val Val Thr Glu Leu Lys Asn
Trp Gly Glu Trp Tyr Val Asn Thr Thr Asn Ile Asp Gly Phe Arg Leu Asp Ala Val Lys His Ile Lys
Phe Ser Phe Phe Pro Asp Trp Leu Ser Tyr Val Arg Ser Gln Thr Gly Lys Pro Leu Phe Thr Val Gly

Figure 16NN

Glu Tyr Trp Ser Tyr Asp Ile Asn Lys Leu HisAsn Tyr Ile Thr Lys Thr Asn Gly Thr Met Ser Leu
Phe Asp Ala Pro Leu His Asn Lys Phe Tyr Thr Ala Ser Lys Ser Gly Gly Ala Phe Asp Met Arg Thr
Leu Met Thr Asn Thr Leu Met Lys Asp Gln Pro Thr Leu Ala Val Thr Phe Val Asp Asn His Asp
Thr Glu Pro Gly Gln Ala Leu Gln Ser Trp Val Asp Pro Trp Phe Lys Pro Leu Ala Tyr Ala Phe Ile
Leu Thr Arg Gln Glu Gly Tyr Pro Cys Val Phe Tyr Gly Asp Tyr Tyr Gly Ile Pro Gln Tyr Asn Ile
Pro Ser Leu Lys Ser Lys Ile Asp Pro Leu Leu Ile Ala Arg Arg Asp Tyr Ala Tyr Gly Thr Gln His
Asp Tyr Leu Asp His Ser Asp Ile Ile Gly Trp Thr Arg Glu Gly Val Thr Glu Lys Pro Gly Ser Gly
Leu Ala Ala Leu Ile Thr Asp Gly Pro Gly Gly Ser Lys Trp Met Tyr Val Gly Lys Gln His Ala Gly
Lys Val Phe Tyr Asp Leu Thr Gly Asn Arg Ser Asp Thr Val Thr Ile Asn Ser Asp Gly Trp Gly Glu
Phe Lys Val Asn Gly Gly Ser Val Ser Val Trp Val Pro Arg Lys Thr Thr Val Ser Thr Ile Ala Arg
Pro Ile Thr Thr Arg Pro Trp Thr Gly Glu Phe Val Arg Trp Thr Glu Pro Arg Leu Val Ala Trp Pro

SEQ ID NO: 105
atgtccctattcaaaaaaatctttccgtggattgtatctctacttcttttgttttcgtttattgctccttttccattcaaacagaaaaagtccgcgctggaa
gtgttccagtgaatggaacgatgatgcaatatttcgaatggtaccttccagacgatggaacactatggacgaaagtagcaaataacgcccaatct
ttagcgaatcttggcattactgccctttggcttccccctgcctataaaggaacaagcagcagtgacgttggatatggcgtttatgatttatatgacct
aggagagtttaatcaaaaaggaactgtccgaacaaaatacggaacaaaaacacaatatatccaagcaatccaagcggcgcatacagcaggaa
tgcaagtatatgcagatgtcgtctttaaccataaagccggtgcagatgggacagaactagtggatgcagtagaagtaaaccttctgaccgcaat
caagaaatatcaggaacatatcaaatccaagcgtggacaaaatttgattttcctggtcgtggaaacacctattctagttttaaatggcgttggtatca
tttcgatggaacggactgggatgagagtagaaaactaaatcgtatttacaaattccgcggcacgggaaaagcatgggattgggaagtagataca
gaaaatgggaattatgactatctcatgtatgcagatttggatatggatcatccagaggttgtatctgaactaaaaaattggggaaagtggtatgtaa
ccacaaccaatatcgacggattccgtctggatgcagtgaagcatattaaatatagcttttcccagactggctatcgtatgtacgaacccaaacac
aaaagcctcttttgccgttggcgaattttggagctatgacattaacaagctacacaactatattacaaagacgaacggctctatgtccctattcgat
gccccgctgcataacaatttttatatagcatcgaaatcaggtggctattttgatatgcgcacattactcaacaacacattgatgaaagatcaaccaa
cactatcggtcacattagtagacaatcacgatactgagccagggcaatctttgcagtcgtgggtcgagccgtggtttaaaccgttagcttacgcat
ttatcttgacccgccaagaaggttatccgtgcatcttttatggagattactatggtattccaaaatacaacattcctgcgctgaaaagcaaacttgatc
cgctgttaattgctcgaagagattatgcctacggaacacagcacgactatattgacaatgcagatattatcggctggacgcgggaaggagtagct
gaaaaagcaaattcgggacttgctgcactcattaccgacggacctggcggaagcaaatggatgtatgttggcaaacaacacgctggcaaaac
gttttatgatctaaccggcaatcgaagtgatacagtgacaatcaacgctgatggatggggagaatttaaagtcaatggagggtctgtatccatatg
ggttccaaaaacatcaaccacttcccaaatcacatttactgtaaataatgccacaaccgtttggggacaaaatgtatacgttgtcgggaatatttcg
cagctgggcaac SEQ ID NO: 106
Met Ser Leu Phe Lys Lys Ile Phe Pro Trp Ile Val Ser Leu Leu Leu Leu Phe Ser Phe Ile Ala Pro Phe
Ser Ile Gln Thr Glu Lys Val Arg Ala Gly Ser Val Pro Val Asn Gly Thr Met Met Gln Tyr Phe Glu
Trp Tyr Leu Pro Asp Asp Gly Thr Leu Trp Thr Lys Val Ala Asn Asn Ala Gln Ser Leu Ala Asn Leu
Gly Ile Thr Ala Leu Trp Leu Pro Pro Ala Tyr Lys Gly Thr Ser Ser Asp Val Gly Tyr Gly Val
Tyr Asp Leu Tyr Asp Leu Gly Glu Phe Asn Gln Lys Gly Thr Val Arg Thr Lys Tyr Gly Thr Lys
Thr Gln Tyr Ile Gln Ala Ile Gln Ala Ala His Thr Ala Gly Met Gln Val Tyr Ala Asp Val Val Phe
Asn His Lys Ala Gly Ala Asp Gly Thr Glu Leu Val Asp Ala Val Glu Val Asn Pro Ser Asp Arg Asn
Gln Glu Ile Ser Gly Thr Tyr Gln Ile Gln Ala Trp Thr Lys Phe Asp Phe Pro Gly Arg Gly Asn Thr
Tyr Ser Ser Phe Lys Trp Arg Trp Tyr His Phe Asp Gly Thr Asp Trp Asp Glu Ser Arg Lys Leu Asn
Arg Ile Tyr Lys Phe Arg Gly Thr Gly Lys Ala Trp Asp Trp Glu Val Asp Thr Glu Asn Gly Asn Tyr
Asp Tyr Leu Met Tyr Ala Asp Leu Asp Met Asp His Pro Glu Val Val Ser Glu Leu Lys Asn Trp
Gly Lys Trp Tyr Val Thr Thr Thr Asn Ile Asp Gly Phe Arg Leu Asp Ala Val Lys His Ile Lys Tyr
Ser Phe Phe Pro Asp Trp Leu Ser Tyr Val Arg Thr Gln Thr Gln Lys Pro Leu Phe Ala Val Gly Glu
Phe Trp Ser Tyr Asp Ile Asn Lys Leu His Asn Tyr Ile Thr Lys Thr Asn Gly Ser Met Ser Leu Phe
Asp Ala Pro Leu His Asn Asn Phe Tyr Ile Ala Ser Lys Ser Gly Gly Tyr Phe Asp Met Arg Thr Leu
Leu Asn Asn Thr Leu Met Lys Asp Gln Pro Thr Leu Ser Val Thr Leu Val Asp Asn His Asp Thr

Figure 16OO

Glu Pro Gly Gln Ser Leu Gln Ser Trp Val Glu Pro Trp Phe Lys Pro Leu Ala Tyr Ala Phe Ile Leu
Thr Arg Gln Glu Gly Tyr Pro Cys Ile Phe Tyr Gly Asp Tyr Tyr Gly Ile Pro Lys Tyr Asn Ile Pro
Ala Leu Lys Ser Lys Leu Asp Pro Leu Leu Ile Ala Arg Arg Asp Tyr Ala Tyr Gly Thr Gln His Asp
Tyr Ile Asp Asn Ala Asp Ile Ile Gly Trp Thr Arg Glu Gly Val Ala Glu Lys Ala Asn Ser Gly Leu
Ala Ala Leu Ile Thr Asp Gly Pro Gly Gly Ser Lys Trp Met Tyr Val Gly Lys Gln His Ala Gly Lys
Thr Phe Tyr Asp Leu Thr Gly Asn Arg Ser Asp Thr Val Thr Ile Asn Ala Asp Gly Trp Gly Glu Phe
Lys Val Asn Gly Gly Ser Val Ser Ile Trp Val Pro Lys Thr Ser Thr Thr Ser Gln Ile Thr Phe Thr Val
Asn Asn Ala Thr Thr Val Trp Gly Gln Asn Val Tyr Val Val Gly Asn Ile Ser Gln Leu Gly Asn

SEQ ID NO: 107
atggacagcctcgacgcgccggagcagaagccctgggtgaaggatggcaggctctccgcgtacctggatacagggacagggaccgtggtc
gctcccgaggcacctgcgcccccgccgcccccggccgaggaagtccggcccgtggacaagtggaaaaacgatatcatctatttcgtcctcac
cgaccgtttccaggatggcgacaagaccaacaacatggacgtggtcccgacggacatgaaaaaatatcatggcggcgacatccagggggctc
atcgacaagctcgactatatcaaggagaccggttcgacggccatctggctcacgcccctatgaagggggcagacccacttcttcgagaccgac
aattaccatggttactggcccattgacttctatgacacggacccccatgtgggccaccatgcagaaatttgaggagcttatcgagaaagcccatga
gaaagggctgaagatcgtgctcgatattccctgaaccacacggcctgggagcatcccttctacaaggacgacagcaagaaggactggttcc
accatataggagatgtgaaggactgggaagatccctactgggctgaaaacggctccatattcggtcttcctgacctggcgcaggaaaaccctg
ccgtggaaaagtacctcatcgacgtggccaagttctgggtagacaagggtattgacggcttcaggcttgacgccgtgaagaacgtgcccctca
acttctgggcgaagtttgaccgggcgattcacgattatgcgggcaaggacttcctcctcgtcggggaatactttgacggaaacccggcgaaagt
cgcgaactaccagagagaggacatgagctcactcttcgattacccgctctactggaccctgaaggacaccttcgccaaggacgggagcatgc
gcaacctggcggcgaagcttgatgagtgcgacaggaattatcccgacccgggcctcatgtcggtttttccttgataaccacgacacgccgaggtt
cctcaccgaggccaacggcaacaaggataagctcaaactggccctcgccttcgcgatgaccatcaaccgcatgcctaccatttattatggcacc
gaggttgccatggaaggcaactgcgatatcatgggcgccgtagataaccggagggacatgcagtgggacaaggatcctgacatgttcaaata
cttcaagactctcaccactgcccgcaatgagcatgaatccctcagggaaggaaagaagctcgagatgtggcaggatgacaaagtctacgcgta
cggggaggcagaccccgaaggacgagtctatcgtggtgcttaacaacggctatgatacgcaggaacgggacataccgctccgccccgagag
cggcatcaagaacggcacggtgctgaaggatgtcatcaccggcgaaaccgtgacggtacagaacggaaaaatccatgcgaaatgcggcgg
caaacaggcgcggatctacgtgcccgcgtag SEQ ID NO: 108
Met Asp Ser Leu Asp Ala Pro Glu Gln Lys Pro Trp Val Lys Asp Gly Arg Leu Ser Ala Tyr Leu Asp
Thr Gly Thr Gly Thr Val Val Ala Pro Glu Ala Pro Ala Pro Pro Pro Pro Ala Glu Glu Val Arg
Pro Val Asp Lys Trp Lys Asn Asp Ile Ile Tyr Phe Val Leu Thr Asp Arg Phe Gln Asp Gly Asp Lys
Thr Asn Asn Met Asp Val Val Pro Thr Asp Met Lys Lys Tyr His Gly Gly Asp Ile Gln Gly Leu Ile
Asp Lys Leu Asp Tyr Ile Lys Glu Thr Gly Ser Thr Ala Ile Trp Leu Thr Pro Pro Met Lys Gly Gln
Thr His Phe Phe Glu Thr Asp Asn Tyr His Gly Tyr Trp Pro Ile Asp Phe Tyr Asp Thr Asp Pro His
Val Gly Thr Met Gln Lys Phe Glu Glu Leu Ile Glu Lys Ala His Glu Lys Gly Leu Lys Ile Val Leu
Asp Ile Pro Leu Asn His Thr Ala Trp Glu His Pro Phe Tyr Lys Asp Asp Ser Lys Lys Asp Trp Phe
His His Ile Gly Asp Val Lys Asp Trp Glu Asp Pro Tyr Trp Ala Glu Asn Gly Ser Ile Phe Gly Leu
Pro Asp Leu Ala Gln Glu Asn Pro Ala Val Glu Lys Tyr Leu Ile Asp Val Ala Lys Phe Trp Val Asp
Lys Gly Ile Asp Gly Phe Arg Leu Asp Ala Val Lys Asn Val Pro Leu Asn Phe Trp Ala Lys Phe Asp
Arg Ala Ile His Asp Tyr Ala Gly Lys Asp Phe Leu Leu Val Gly Glu Tyr Phe Asp Gly Asn Pro Ala
Lys Val Ala Asn Tyr Gln Arg Glu Asp Met Ser Ser Leu Phe Asp Tyr Pro Leu Tyr Trp Thr Leu Lys
Asp Thr Phe Ala Lys Asp Gly Ser Met Arg Asn Leu Ala Ala Lys Leu Asp Glu Cys Asp Arg Asn
Tyr Pro Asp Pro Gly Leu Met Ser Val Phe Leu Asp Asn His Asp Thr Pro Arg Phe Leu Thr Glu Ala
Asn Gly Asn Lys Asp Lys Leu Lys Leu Ala Leu Ala Phe Ala Met Thr Ile Asn Arg Met Pro Thr Ile
Tyr Tyr Gly Thr Glu Val Ala Met Glu Gly Asn Cys Asp Ile Met Gly Ala Val Asp Asn Arg Arg
Asp Met Gln Trp Asp Lys Asp Pro Asp Met Phe Lys Tyr Phe Lys Thr Leu Thr Thr Ala Arg Asn
Glu His Glu Ser Leu Arg Glu Gly Lys Lys Leu Glu Met Trp Gln Asp Asp Lys Val Tyr Ala Tyr Gly
Arg Gln Thr Pro Lys Asp Glu Ser Ile Val Val Leu Asn Asn Gly Tyr Asp Thr Gln Glu Arg Asp Ile Pro Leu Arg Pro Glu Ser Gly Ile Lys Asn Gly Thr Val Leu Lys Asp Val Ile Thr Gly Glu Thr Val
Thr Val Gln Asn Gly Lys Ile His Ala Lys Cys Gly Gly Lys Gln Ala Arg Ile Tyr Val Pro Ala SEQ ID NO: 109
atggcaagaaaaacgctggccatattttcgtacttctagtgcttcttagtctctcggcagttccggcaaaggcagaaactctagagaatggtgga
gttataatgcaggctttctattgggatgttcctggaggaggaatctggtgggacacaatagctcaaaagatacccgaatgggcaagtgcaggaat
ctcagcgatatggattccaccagcgagtaagggcatgagcggtggttattccatgggctacgatccctacgatttctttgacctcggcgagtacta
tcagaaggggacagttgagacgcgcttcggctcaaaggaagaactggtgaacatgataaacaccgcacactcctacggcataaaggtgatag
cggacatagtcataaaccaccgcgccggtggagaccttgagtggaaccccttcgtgaacgactatacctggacagacttctcaaaagtcgcctc
cggtaaatatacggccaactaccttgacttccacccaaacgagcttcactgttgtgatgaaggtaccttggaggataccctgatatatgtcacga
caaaagctgggaccagtactggctctgggcgagcagcgaaagctacgctgcctacctcaggagcataggggttgacgcctggcgtttcgact
acgtcaagggctacggagcatggttgttaacgactggctcagctggtggggaggctggccgttggagagtactgggacacgaacgttgat
gcactcctcaactgggcatacagcagcggcgccaaggtctttgacttcccgctctactacaagatggacgaagccttcgacaacaccaacatcc
cggcattagtggatgcactcagatacggccagacagtggtcagccgcgatccttcaaggcggtaactttcgttgccaaccacgatacagatat
aatctggaacaagtatccggcttatgcattcatccttacctatgagggacagcctgttatattctaccgcgactacgaggagtggctcaacaagga
taagcttaacaacctcatctggatacacgatcaccttgctggagggagtactgacattgtttactacgacagcgacgagcttatctttgtgagaaac
ggctatggcaccaaaccaggactgataacctatatcaacctcggctcaagcaaagttggaaggtgggtctacgttccaaagttcgccggttcat
gcatccacgagtacaccggcaacctcggcggttggatagacaagtacgtctcctccagcggctgggtctatcttgaggccccagcccacgac
ccggcgaacggctactacggctactctgtctggagctactgcggtgtggggttga SEQ ID NO: 110
Met Ala Arg Lys Thr Leu Ala Ile Phe Phe Val Leu Leu Val Leu Leu Ser Leu Ser Ala Val Pro Ala
Lys Ala Glu Thr Leu Glu Asn Gly Gly Val Ile Met Gln Ala Phe Tyr Trp Asp Val Pro Gly Gly Gly
Ile Trp Trp Asp Thr Ile Ala Gln Lys Ile Pro Glu Trp Ala Ser Ala Gly Ile Ser Ala Ile Trp Ile Pro Pro
Ala Ser Lys Gly Met Ser Gly Gly Tyr Ser Met Gly Tyr Asp Pro Tyr Asp Phe Phe Asp Leu Gly Glu
Tyr Tyr Gln Lys Gly Thr Val Glu Thr Arg Phe Gly Ser Lys Glu Glu Leu Val Asn Met Ile Asn Thr
Ala His Ser Tyr Gly Ile Lys Val Ile Ala Asp Ile Val Ile Asn His Arg Ala Gly Gly Asp Leu Glu Trp
Asn Pro Phe Val Asn Asp Tyr Thr Trp Thr Asp Phe Ser Lys Val Ala Ser Gly Lys Tyr Thr Ala Asn
Tyr Leu Asp Phe His Pro Asn Glu Leu His Cys Cys Asp Glu Gly Thr Phe Gly Gly Tyr Pro Asp Ile
Cys His Asp Lys Ser Trp Asp Gln Tyr Trp Leu Trp Ala Ser Ser Glu Ser Tyr Ala Ala Tyr Leu Arg
Ser Ile Gly Val Asp Ala Trp Arg Phe Asp Tyr Val Lys Gly Tyr Gly Ala Trp Val Val Asn Asp Trp
Leu Ser Trp Trp Gly Gly Trp Ala Val Gly Glu Tyr Trp Asp Thr Asn Val Asp Ala Leu Leu Asn Trp
Ala Tyr Ser Ser Gly Ala Lys Val Phe Asp Phe Pro Leu Tyr Tyr Lys Met Asp Glu Ala Phe Asp Asn
Thr Asn Ile Pro Ala Leu Val Asp Ala Leu Arg Tyr Gly Gln Thr Val Val Ser Arg Asp Pro Phe Lys
Ala Val Thr Phe Val Ala Asn His Asp Thr Asp Ile Ile Trp Asn Lys Tyr Pro Ala Tyr Ala Phe Ile
Leu Thr Tyr Glu Gly Gln Pro Val Ile Phe Tyr Arg Asp Tyr Glu Glu Trp Leu Asn Lys Asp Lys Leu
Asn Asn Leu Ile Trp Ile His Asp His Leu Ala Gly Gly Ser Thr Asp Ile Val Tyr Tyr Asp Ser Asp
Glu Leu Ile Phe Val Arg Asn Gly Tyr Gly Thr Lys Pro Gly Leu Ile Thr Tyr Ile Asn Leu Gly Ser
Ser Lys Val Gly Arg Trp Val Tyr Val Pro Lys Phe Ala Gly Ser Cys Ile His Glu Tyr Thr Gly Asn
Leu Gly Gly Trp Ile Asp Lys Tyr Val Ser Ser Ser Gly Trp Val Tyr Leu Glu Ala Pro Ala His Asp
Pro Ala Asn Gly Tyr Tyr Gly Tyr Ser Val Trp Ser Tyr Cys Gly Val Gly SEQ ID NO: 111
atgcccgcgttcaaatctaaggtgatgcacatgaagttgaagtaccttgctttagttttgttggctgtggcttcgataggcctcctctcgactccagt
gggtgctgccaagtactccgaactcgaagagggcggtgttataatgcaggccttctactgggacgtccctaccggtgggatctggtgggacac
cataagacagaaatcccggagtggtacgacgctggaatctcggcgatatggattccaccagctagcaaaggtatgggtggtgcatactccatg
ggttatgaccctacgatttctttgacctcggcgagtactatcagaagggaacagttgagacgcgcttcggctcaaaggaggaactggtgaaca
tgataaacaccgcacactcctatggcataaaggtgatagcggacatagtcataaaccaccgcgccggcggcgacctggagtggaaccccttg
taaacaactatacttggacagacttctccaaggtcgcctccggtaaatacacggccaactaccttgacttccacccaaacgaggtcaagtgctgc
gatgagggtacatttggtgacttccggacatcgcccacgagaagagctgggatcagtactggctctgggcaagcaatgagagctacgccgcc

Figure 16QQ tatctccggagcatagggatcgatgcatggcgtttcgactacgtcaaaggttacggagcgtgggttgttaacgactggctcagctggtggggag
gttgggccgttggagagtactgggacaccaacgttgatgcactccttaactgggcatacaacagcggtgccaaggtctttgacttccgctctac
tacaagatggacgaagcctttgacaacaccaacatccccgctttggtttacgccctccagaacggaggaacagtcgtttcccgcgatcccttcaa
ggcagtaactttcgttgccaaccacgataccgatataatctggaacaagtatccggcttatgcgttcatccttacctatgagggacagcctgttatat
tctaccgcgactacgaggagtggctcaacaaggataagcttaacaaccttatctggatacacgagcaccttgccggaggaagtaccaagatcct
ctactacgataacgatgagctaatattcatgagggagggctacgggagcaagccgggcctcataacctacataaacctcggaaacgactggg
ccgagcgctgggtgaacgtcggctcaaagtttgccggctacacaatccatgaatacacaggcaatctcggtggctgggttgacaggtgggttc
agtacgacggatgggttaaactgacggcacctcctcacgatccagccaacggatattacggctactcagtctggagctacgcaggcgtcggat
ga SEQ ID NO: 112
Met Pro Ala Phe Lys Ser Lys Val Met His Met Lys Leu Lys Tyr Leu Ala Leu Val Leu Leu Ala Val
Ala Ser Ile Gly Leu Leu Ser Thr Pro Val Gly Ala Ala Lys Tyr Ser Glu Leu Glu Glu Gly Gly Val Ile
Met Gln Ala Phe Tyr Trp Asp Val Pro Thr Gly Gly Ile Trp Trp Asp Thr Ile Arg Gln Lys Ile Pro
Glu Trp Tyr Asp Ala Gly Ile Ser Ala Ile Trp Ile Pro Pro Ala Ser Lys Gly Met Gly Gly Ala Tyr Ser
Met Gly Tyr Asp Pro Tyr Asp Phe Phe Asp Leu Gly Glu Tyr Tyr Gln Lys Gly Thr Val Glu Thr
Arg Phe Gly Ser Lys Glu Glu Leu Val Asn Met Ile Asn Thr Ala His Ser Tyr Gly Ile Lys Val Ile
Ala Asp Ile Val Ile Asn His Arg Ala Gly Gly Asp Leu Glu Trp Asn Pro Phe Val Asn Asn Tyr Thr
Trp Thr Asp Phe Ser Lys Val Ala Ser Gly Lys Tyr Thr Ala Asn Tyr Leu Asp Phe His Pro Asn Glu
Val Lys Cys Cys Asp Glu Gly Thr Phe Gly Asp Phe Pro Asp Ile Ala His Glu Lys Ser Trp Asp Gln
Tyr Trp Leu Trp Ala Ser Asn Glu Ser Tyr Ala Ala Tyr Leu Arg Ser Ile Gly Ile Asp Ala Trp Arg
Phe Asp Tyr Val Lys Gly Tyr Gly Ala Trp Val Val Asn Asp Trp Leu Ser Trp Trp Gly Gly Trp Ala
Val Gly Glu Tyr Trp Asp Thr Asn Val Asp Ala Leu Leu Asn Trp Ala Tyr Asn Ser Gly Ala Lys Val
Phe Asp Phe Pro Leu Tyr Tyr Lys Met Asp Glu Ala Phe Asp Asn Thr Asn Ile Pro Ala Leu Val Tyr
Ala Leu Gln Asn Gly Gly Thr Val Val Ser Arg Asp Pro Phe Lys Ala Val Thr Phe Val Ala Asn His
Asp Thr Asp Ile Ile Trp Asn Lys Tyr Pro Ala Tyr Ala Phe Ile Leu Thr Tyr Glu Gly Gln Pro Val Ile
Phe Tyr Arg Asp Tyr Glu Glu Trp Leu Asn Lys Asp Lys Leu Asn Asn Leu Ile Trp Ile His Glu His
Leu Ala Gly Gly Ser Thr Lys Ile Leu Tyr Tyr Asp Asn Asp Glu Leu Ile Phe Met Arg Glu Gly Tyr
Gly Ser Lys Pro Gly Leu Ile Thr Tyr Ile Asn Leu Gly Asn Asp Trp Ala Glu Arg Trp Val Asn Val
Gly Ser Lys Phe Ala Gly Tyr Thr Ile His Glu Tyr Thr Gly Asn Leu Gly Gly Trp Val Asp Arg Trp
Val Gln Tyr Asp Gly Trp Val Lys Leu Thr Ala Pro Pro His Asp Pro Ala Asn Gly Tyr Tyr Gly Tyr
Ser Val Trp Ser Tyr Ala Gly Val Gly SEQ ID NO: 113
atgaaacaacaaaaacggctttacgcccgattgctgacgctgttatttgcgctcatcttcttgctgcctcattctgcagcagcggcggcaaatctta
atgggacgctgatgcagtattttgaatggtacatgcccaatgacggccaacattggaagcgcttgcaaaacgactcggcatatttggctgaacac
ggtattactgccgtctggattcccccggcatataaggcgaacgagccaagcggatgtgggctacggtgcttacgaccttatgattagggagttt
catcaaaaagggacggttcggacaaagtacggcacaaaaggagagctgcaatctgcgatcaaaagtcttcattcccgcgacattaacgtttacg
gggatgtggtcatcaaccacaaaggcggcgctgatgcgaccgaagatgtaaccgcggttgaagtcgatcccgctgaccgcaaccgcgtaatt
tcaggagaacaccgaattaaagcctggacacattttcattttccggggcgcggcagcacatacagcgattttaaatggcattggtaccattttgac
ggaaccgattgggacgagtcccgaaagctgaaccgcatctataagtttcaaggaaaggcttgggattgggaagtttccaatgaaaacggcaac
tatgattatttgatgtatgccgacatcgattatgaccatcctgatgtcgcagcagaaattaagagatggggcacttggtatgccaatgaactgcaatt
ggacggtttccgtcttgatgctgtcaaacacattaaattttctttttttgcgggattgggttaatcatgtcagggaaaaaacggggaaggaaatgttta
cggtagctgaatattggcagaatgacttggcgcgctggaaaactatttgaacaaaacaaattttaatcattcagtgtttgacgtgccgcttcattat
cagttccatgctgcatcgacacaggaggcggctatgatatgaggaaattgctgaacggtacggtcgtttccaagcatccgttgaaagcggtta
cattgtcgataaccatgatacacagccggggcaatcgcttgagtcgactgtccaaacatggtttaagccgcttgcttacgcttcattctcacaag
ggaatctggatacccctcaggttttctacggggatatgtacgggacgaaaggagactcccagcgcgaaattcctgccttgaaacacaaaattgaa
ccgatcttaaaagcgagaaaacagtatgcgtacggagcacagcatgattatttcgaccaccatgacattgtcggctggacaagggaaggcgac
agctcggttgcaaattcaggtttggcggcattaataacagacggacccggtggggcaaagcgaatgtatgtcggccggcaaaacgccggtga

Figure 16RR gacatggcatgacattaccggaaaccgttcggagccggttgtcatcaattcggaaggctggggagagtttcacgtaaacggcgggtcggtttca
atttatgttcaaagatag SEQ ID NO: 114
Met Lys Gln Gln Lys Arg Leu Tyr Ala Arg Leu Leu Thr Leu Leu Phe Ala Leu Ile Phe Leu Leu Pro
His Ser Ala Ala Ala Ala Ala Asn Leu Asn Gly Thr Leu Met Gln Tyr Phe Glu Trp Tyr Met Pro Asn
Asp Gly Gln His Trp Lys Arg Leu Gln Asn Asp Ser Ala Tyr Leu Ala Glu His Gly Ile Thr Ala Val
Trp Ile Pro Pro Ala Tyr Lys Gly Thr Ser Gln Ala Asp Val Gly Tyr Gly Ala Tyr Asp Leu Tyr Asp
Leu Gly Glu Phe His Gln Lys Gly Thr Val Arg Thr Lys Tyr Gly Thr Lys Gly Glu Leu Gln Ser Ala
Ile Lys Ser Leu His Ser Arg Asp Ile Asn Val Tyr Gly Asp Val Val Ile Asn His Lys Gly Gly Ala
Asp Ala Thr Glu Asp Val Thr Ala Val Glu Val Asp Pro Ala Asp Arg Asn Arg Val Ile Ser Gly Glu
His Arg Ile Lys Ala Trp Thr His Phe His Phe Pro Gly Arg Gly Ser Thr Tyr Ser Asp Phe Lys Trp
His Trp Tyr His Phe Asp Gly Thr Asp Trp Asp Glu Ser Arg Lys Leu Asn Arg Ile Tyr Lys Phe Gln
Gly Lys Ala Trp Asp Trp Glu Val Ser Asn Glu Asn Gly Asn Tyr Asp Tyr Leu Met Tyr Ala Asp Ile
Asp Tyr Asp His Pro Asp Val Ala Ala Glu Ile Lys Arg Trp Gly Thr Trp Tyr Ala Asn Glu Leu Gln
Leu Asp Gly Phe Arg Leu Asp Ala Val Lys His Ile Lys Phe Ser Phe Leu Arg Asp Trp Val Asn His
Val Arg Glu Lys Thr Gly Lys Glu Met Phe Thr Val Ala Glu Tyr Trp Gln Asn Asp Leu Gly Ala
Leu Glu Asn Tyr Leu Asn Lys Thr Asn Phe Asn His Ser Val Phe Asp Val Pro Leu His Tyr Gln Phe
His Ala Ala Ser Thr Gln Gly Gly Gly Tyr Asp Met Arg Lys Leu Leu Asn Gly Thr Val Val Ser Lys
His Pro Leu Lys Ala Val Thr Phe Val Asp Asn His Asp Thr Gln Pro Gly Gln Ser Leu Glu Ser Thr
Val Gln Thr Trp Phe Lys Pro Leu Ala Tyr Ala Phe Ile Leu Thr Arg Glu Ser Gly Tyr Pro Gln Val
Phe Tyr Gly Asp Met Tyr Gly Thr Lys Gly Asp Ser Gln Arg Glu Ile Pro Ala Leu Lys His Lys Ile
Glu Pro Ile Leu Lys Ala Arg Lys Gln Tyr Ala Tyr Gly Ala Gln His Asp Tyr Phe Asp His His Asp
Ile Val Gly Trp Thr Arg Glu Gly Asp Ser Ser Val Ala Asn Ser Gly Leu Ala Ala Leu Ile Thr Asp
Gly Pro Gly Gly Ala Lys Arg Met Tyr Val Gly Arg Gln Asn Ala Gly Glu Thr Trp His Asp Ile Thr
Gly Asn Arg Ser Glu Pro Val Val Ile Asn Ser Glu Gly Trp Gly Glu Phe His Val Asn Gly Gly Ser
Val Ser Ile Tyr Val Gln Arg SEQ ID NO: 115
atggcgaagtactccgagctggagcagggcggagtcataatgcaggccttctactgggacgttccggagggaggaatctggtgggacacaat
acggcagaagatccctgaatggtacgatgcaggcatatccgccatctggataccccggcgagcaagggcatgggcggggcctactcgatg
ggctacgaccccctacgattacttcgatctgggcgagtttttaccagaagggaaccgttgagacccgcttcggctccaaggaagagctcgtcaaca
tgatctccacggcccaccagtacggcatcaaggttatagcggacatagtgataaaccaccgcgcaggtggagacctcgaatggaacccatac
gtcggcgactatacctggacggactttctaaggtcgcctccgggaaatacaaggcccactacatggacttccatccaaacaactacagcacct
cagacgagggaaccttcggtggcttcccagacattgatcacctcgtgccttcaaccagtactggctgtgggcgagcaacgagagctacgccg
cctacctcaggagcatagggatcgatgcgtggcgctttgactacgttaagggctacggcgcgtgggtcgtcaaggactggctgagtcagtggg
gcggctggccgtcggcgagtactgggacaccaacgtcgatgcgctcctcaactgggcctacagcagcggcgccaaggtcttcgacttccc
gctctactacaagatggacgaggcctttgacaacaagaacattcccgccctcgtttacgccatccagaacggtgaaaccgtcgtcagcagggat
cccttcaaggccgttaccttcgtggctaaccacgatacgaacataatctggaacaagtaccctgcctatgccttcatcctgacctacgaaggtcag
cccgtcatcttctaccgcgactacgaggagtggctcaacaaggacaaactcaacaacctcatatggattcacgagcacctggcaggggggaag
caccaagatcctctactacgacgacgatgagctcatcttcatgagggaaggctacggcgacaggcccgggcttataacctacatcaacctcggt
agcgactgggcggagagatgggtgaacgttggctcaaagttcgcgggctatacaatccacgaatacaccggaaacctcggcggctgggtcg
acaggtacgtccagtacgacggctgggtcaagcttaccgctccgccacacgatccggcaaacggctattacggctactcggtctggagctacg
ccggagttggaagatctcatcaccatcaccatcactaa SEQ ID NO: 116
Met Ala Lys Tyr Ser Glu Leu Glu Gln Gly Gly Val Ile Met Gln Ala Phe Tyr Trp Asp Val Pro Glu
Gly Gly Ile Trp Trp Asp Thr Ile Arg Gln Lys Ile Pro Glu Trp Tyr Asp Ala Gly Ile Ser Ala Ile Trp
Ile Pro Pro Ala Ser Lys Gly Met Gly Gly Ala Tyr Ser Met Gly Tyr Asp Pro Tyr Asp Tyr Phe Asp
Leu Gly Glu Phe Tyr Gln Lys Gly Thr Val Glu Thr Arg Phe Gly Ser Lys Glu Glu Leu Val Asn Met

Figure 16SS

Ile Ser Thr Ala His Gln Tyr Gly Ile Lys Val Ile Ala Asp Ile Val Ile Asn His Arg Ala Gly Gly Asp
Leu Glu Trp Asn Pro Tyr Val Gly Asp Tyr Thr Trp Thr Asp Phe Ser Lys Val Ala Ser Gly Lys Tyr
Lys Ala His Tyr Met Asp Phe His Pro Asn Asn Tyr Ser Thr Ser Asp Glu Gly Thr Phe Gly Gly Phe
Pro Asp Ile Asp His Leu Val Pro Phe Asn Gln Tyr Trp Leu Trp Ala Ser Asn Glu Ser Tyr Ala Ala
Tyr Leu Arg Ser Ile Gly Ile Asp Ala Trp Arg Phe Asp Tyr Val Lys Gly Tyr Gly Ala Trp Val Val
Lys Asp Trp Leu Ser Gln Trp Gly Gly Trp Ala Val Gly Glu Tyr Trp Asp Thr Asn Val Asp Ala Leu
Leu Asn Trp Ala Tyr Ser Ser Gly Ala Lys Val Phe Asp Phe Pro Leu Tyr Tyr Lys Met Asp Glu Ala
Phe Asp Asn Lys Asn Ile Pro Ala Leu Val Tyr Ala Ile Gln Asn Gly Glu Thr Val Val Ser Arg Asp
Pro Phe Lys Ala Val Thr Phe Val Ala Asn His Asp Thr Asn Ile Ile Trp Asn Lys Tyr Pro Ala Tyr
Ala Phe Ile Leu Thr Tyr Glu Gly Gln Pro Val Ile Phe Tyr Arg Asp Tyr Glu Glu Trp Leu Asn Lys
Asp Lys Leu Asn Asn Leu Ile Trp Ile His Glu His Leu Ala Gly Gly Ser Thr Lys Ile Leu Tyr Tyr
Asp Asp Asp Glu Leu Ile Phe Met Arg Glu Gly Tyr Gly Asp Arg Pro Gly Leu Ile Thr Tyr Ile Asn
Leu Gly Ser Asp Trp Ala Glu Arg Trp Val Asn Val Gly Ser Lys Phe Ala Gly Tyr Thr Ile His Glu
Tyr Thr Gly Asn Leu Gly Gly Trp Val Asp Arg Tyr Val Gln Tyr Asp Gly Trp Val Lys Leu Thr Ala
Pro Pro His Asp Pro Ala Asn Gly Tyr Tyr Gly Tyr Ser Val Trp Ser Tyr Ala Gly Val Gly Arg Ser
His His His His His His

SEQ ID NO: 117
ttgcgagtgttcctggttgtgccaaagctgagccgcccatttcaggcagagtcacaacaacaagacagggacataacaatgaaacacacagcg
ggaatgctggcgatcgcaggtatgctgatcgccccccttggcgcatgccgatgtcatactgcacgccttcaactggaaatacagtgaagtcaccg
ccaaggccgatctcatcaaggctgccggctacaagcaggtgctcatctcaccgcctctgaagtcctcgggcaacgagtggtgggctcgttacc
agccccaggatctgcgcctggtcgacaccccccttggcaacaagcaggatctggagcagctgatcgccgcgatgcagacccggggcattgc
cgtctacgcggacgtggtgctcaaccacatggccaacgaaagctggaagcgcagcgacctcaactaccccggcagcgagctgctgcaaag
ctacgccggcaatccggcctactttgaacgccagaagctctttggcgatctgggggcagaacttcctcgccggccaggattttcatccggagggg
tgcatcaccgactggaacaatccgggccatgtccagtactggcgactgtgcggcggggcgggtgacaagggggctgccggatctggacccca
acaactgggtggtgaaccagcaacaggcttacctgcaggcgctcaaggggatggggatcaagggttttcgggtcgatgcggtcaagcacatg
agcgattaccagatcaacgccgtgttcacccccgagatcaaacaggggatgcacgtctttggcgaggtgatcaccacgggggggcgccggca
acagcgactatgagaacttcctcaaacccacctcgacagcagcggccagggggcctacgacttcccgctcttcgcctccctgcgtggagcgc
tgggctacggcggcagcatgaacctgctggccgatcccggtgcctatggtcaggcgctgccgggtagccgcgccgtcaccttcgccatcacc
cacgacatccccaccaacgacggtttccgctaccagatcctcaaccagaccgacgagagactggcctatgcctacctgctcggtcgcgatggc
ggttcgcctctggtctactccgatcacggtgaaaccagggacaaggacggattgcgctggcaggactactatctgcgcaccgatctcaaaggg
atgatccgcttccataacacagtgcagggtcaaccgatgcagctcatcggcagtaacgactgcttcgtgctgttcaagcgtggcaagcagggc
gtggtcggcatcaacaagtgcgactacgagcaggagtactggctcgataccgccagattcgagatgaactggtatcgcaactaccgggatgtg
ctcgaccagaatgccgtggtcaacgtgcagagccagtgggtaaggctgaccatcccggcccgcggcgccagaatgtggctgcaggagtga SEQ ID NO: 118
Met Arg Val Phe Leu Val Val Pro Lys Leu Ser Arg Pro Phe Gln Ala Glu Ser Gln Gln Gln Asp Arg
Asp Ile Thr Met Lys His Thr Ala Gly Met Leu Ala Ile Ala Gly Met Leu Ile Ala Pro Leu Ala His
Ala Asp Val Ile Leu His Ala Phe Asn Trp Lys Tyr Ser Glu Val Thr Ala Lys Ala Asp Leu Ile Lys
Ala Ala Gly Tyr Lys Gln Val Leu Ile Ser Pro Pro Leu Lys Ser Ser Gly Asn Glu Trp Trp Ala Arg
Tyr Gln Pro Gln Asp Leu Arg Leu Val Asp Thr Pro Leu Gly Asn Lys Gln Asp Leu Glu Gln Leu Ile
Ala Ala Met Gln Thr Arg Gly Ile Ala Val Tyr Ala Asp Val Val Leu Asn His Met Ala Asn Glu Ser
Trp Lys Arg Ser Asp Leu Asn Tyr Pro Gly Ser Glu Leu Leu Gln Ser Tyr Ala Gly Asn Pro Ala Tyr
Phe Glu Arg Gln Lys Leu Phe Gly Asp Leu Gly Gln Asn Phe Leu Ala Gly Gln Asp Phe His Pro
Glu Gly Cys Ile Thr Asp Trp Asn Asn Pro Gly His Val Gln Tyr Trp Arg Leu Cys Gly Gly Ala Gly
Asp Lys Gly Leu Pro Asp Leu Asp Pro Asn Asn Trp Val Val Asn Gln Gln Gln Ala Tyr Leu Gln
Ala Leu Lys Gly Met Gly Ile Lys Gly Phe Arg Val Asp Ala Val Lys His Met Ser Asp Tyr Gln Ile
Asn Ala Val Phe Thr Pro Glu Ile Lys Gln Gly Met His Val Phe Gly Glu Val Ile Thr Thr Gly Gly
Ala Gly Asn Ser Asp Tyr Glu Asn Phe Leu Lys Pro Tyr Leu Asp Ser Ser Gly Gln Gly Ala Tyr Asp
Phe Pro Leu Phe Ala Ser Leu Arg Gly Ala Leu Gly Tyr Gly Gly Ser Met Asn Leu Leu Ala Asp Pro

Figure 16TT

Gly Ala Tyr Gly Gln Ala Leu Pro Gly Ser Arg Ala Val Thr Phe Ala Ile Thr His Asp Ile Pro Thr
Asn Asp Gly Phe Arg Tyr Gln Ile Leu Asn Gln Thr Asp Glu Arg Leu Ala Tyr Ala Tyr Leu Leu Gly
Arg Asp Gly Gly Ser Pro Leu Val Tyr Ser Asp His Gly Glu Thr Arg Asp Lys Asp Gly Leu Arg Trp
Gln Asp Tyr Tyr Leu Arg Thr Asp Leu Lys Gly Met Ile Arg Phe His Asn Thr Val Gln Gly Gln Pro
Met Gln Leu Ile Gly Ser Asn Asp Cys Phe Val Leu Phe Lys Arg Gly Lys Gln Gly Val Val Gly Ile
Asn Lys Cys Asp Tyr Glu Gln Glu Tyr Trp Leu Asp Thr Ala Arg Phe Glu Met Asn Trp Tyr Arg
Asn Tyr Arg Asp Val Leu Asp Gln Asn Ala Val Val Asn Val Gln Ser Gln Trp Val Arg Leu Thr Ile
Pro Ala Arg Gly Ala Arg Met Trp Leu Gln Glu

SEQ ID NO: 119
atgcaaacgtttgcattcttatttactcaaagaaaggatgggtgtgcatgaattatttgaaaaaagtgtggttgtattacgctatcgtcgctaccttaa
tcatttcctttcttacaccttttcaacagcacaagctaatactgcacctgttaacggaacaatgatgcaatatttcgaatgggacttacctaatgatgg
gacgctttggacgaaagtaaaaaatgaagctaccaatctttcttcactaggtatcacagcactatggctccctccagcatataaaggaacgagcc
aaagcgatgtcggatacggtgtttacgatttatatgaccttggggaatttaatcaaaaagggacgatccgaacgaaatacggaacaaaaacaca
atatattcaagccattcaaactgcccaagccgcagggatgcaagtatatgcggatgttgtatttaatcataaggcagggctgacagtacagaatt
tgtcgatgcagttgaggtaaaccccttctaatcgaaatcaagaaacatctggcacatatcaaattcaagcatggacaaaatttgattttcctggtcgtg
gaaacacatactccagcttcaaatggcgctggtaccattttgatggtacggattgggacgaaagtcgtaaattaaatcgtatttacaaattccgcgg
tacaggaaaagcgtgggactgggaagtcgatacagaaaacggaaactatgattatttaatgttcgctgatttagatatggatcaccctgaggttgt
gacagaattaaaaaactggggaacgtggtacgtcaatactacaaatatcgatggattccgcttagatgccgtaaaacatattaaatacagcttttc
cctgactggctaacatatgtacgtaatcaaacaggaaaaaatttatttgccgttggggaattttggagctatgacgtcaataagctgcataattacat
tacaaaaacaaatgggtcgatgtcattatttgatgcaccccttgcataacaacttttataccgcttccaaatcgagtggatatttttgacatgcgttatttat
tgaataatacattaatgaaagatcaaccttcactcgctgtaacacttgtcgataaccacgacacgcaaccagggcaatctttacagtcatgggtcg
aaccttggtttaaacagcttgcttacgcctttattttaacaagacaagaagggtatccttgcgtatttacggtgattattatggaatccctaaatacaat
atcccgggggttaaaaagtaaaatcgacccgctttaattgctcgtcgtgattacgcttatggaacacaacgtgattacattgatcatcaagacattat
cggatggacacgagaaggcattgatgcaaaaccgaactctggactggcggctttaattaccgacggtcctggtggaagtaaatggatgtatgtc
ggtaaaaagcatgccgggaaagtatttatgatttaactggaaatcgaagtgacacagtaacgattaatgcggatggttgggggagaatttaaagta
aacggaggatccgtctcaatttgggtggctaaaacgtcaaacgtcacatttacagtcaataacgccacaacaacaagcggacaaaacgtatatg
ttgtcggcaacattccagagctaggcaattgtcgcacgggttaa SEQ ID NO: 120
Met Gln Thr Phe Ala Phe Leu Phe Tyr Ser Lys Lys Gly Trp Val Cys Met Asn Tyr Leu Lys Lys Val
Trp Leu Tyr Tyr Ala Ile Val Ala Thr Leu Ile Ile Ser Phe Leu Thr Pro Phe Ser Thr Ala Gln Ala Asn
Thr Ala Pro Val Asn Gly Thr Met Met Gln Tyr Phe Glu Trp Asp Leu Pro Asn Asp Gly Thr Leu
Trp Thr Lys Val Lys Asn Glu Ala Thr Asn Leu Ser Ser Leu Gly Ile Thr Ala Leu Trp Leu Pro Pro
Ala Tyr Lys Gly Thr Ser Gln Ser Asp Val Gly Tyr Gly Val Tyr Asp Leu Tyr Asp Leu Gly Glu Phe
Asn Gln Lys Gly Thr Ile Arg Thr Lys Tyr Gly Thr Lys Thr Gln Tyr Ile Gln Ala Ile Gln Thr Ala
Gln Ala Ala Gly Met Gln Val Tyr Ala Asp Val Val Phe Asn His Lys Ala Gly Ala Asp Ser Thr Glu
Phe Val Asp Ala Val Glu Val Asn Pro Ser Asn Arg Asn Gln Glu Thr Ser Gly Thr Tyr Gln Ile Gln
Ala Trp Thr Lys Phe Asp Phe Pro Gly Arg Gly Asn Thr Tyr Ser Ser Phe Lys Trp Arg Trp Tyr His
Phe Asp Gly Thr Asp Trp Asp Glu Ser Arg Lys Leu Asn Arg Ile Tyr Lys Phe Arg Gly Thr Gly Lys
Ala Trp Asp Trp Glu Val Asp Thr Glu Asn Gly Asn Tyr Asp Tyr Leu Met Phe Ala Asp Leu Asp
Met Asp His Pro Glu Val Val Thr Glu Leu Lys Asn Trp Gly Thr Trp Tyr Val Asn Thr Thr Asn Ile
Asp Gly Phe Arg Leu Asp Ala Val Lys His Ile Lys Tyr Ser Phe Phe Pro Asp Trp Leu Thr Tyr Val
Arg Asn Gln Thr Gly Lys Asn Leu Phe Ala Val Gly Glu Phe Trp Ser Tyr Asp Val Asn Lys Leu His
Asn Tyr Ile Thr Lys Thr Asn Gly Ser Met Ser Leu Phe Asp Ala Pro Leu His Asn Asn Phe Tyr Thr
Ala Ser Lys Ser Ser Gly Tyr Phe Asp Met Arg Tyr Leu Leu Asn Asn Thr Leu Met Lys Asp Gln
Pro Ser Leu Ala Val Thr Leu Val Asp Asn His Asp Thr Gln Pro Gly Gln Ser Leu Gln Ser Trp Val
Glu Pro Trp Phe Lys Gln Leu Ala Tyr Ala Phe Ile Leu Thr Arg Gln Glu Gly Tyr Pro Cys Val Phe
Tyr Gly Asp Tyr Tyr Gly Ile Pro Lys Tyr Asn Ile Pro Gly Leu Lys Ser Lys Ile Asp Pro Leu Leu Ile
Ala Arg Arg Asp Tyr Ala Tyr Gly Thr Gln Arg Asp Tyr Ile Asp His Gln Asp Ile Ile Gly Trp Thr

Figure 16UU

Arg Glu Gly Ile Asp Ala Lys Pro Asn Ser Gly Leu Ala Ala Leu Ile Thr Asp Gly Pro Gly Gly Ser
Lys Trp Met Tyr Val Gly Lys Lys His Ala Gly Lys Val Phe Tyr Asp Leu Thr Gly Asn Arg Ser Asp
Thr Val Thr Ile Asn Ala Asp Gly Trp Gly Glu Phe Lys Val Asn Gly Gly Ser Val Ser Ile Trp Val
Ala Lys Thr Ser Asn Val Thr Phe Thr Val Asn Asn Ala Thr Thr Thr Ser Gly Gln Asn Val Tyr Val
Val Gly Asn Ile Pro Glu Leu Gly Asn Cys Arg Thr Gly

SEQ ID NO: 121 atgctcgccctgtcgctcggcggctgcggcatcgacgcgggcccgacaggccctcgcgtcgtggagccgctgccgcagcgcccacgcttc
cgcaggagtaccgcgccagcggccacgcggccgccggcgacgtgttcgtgcacctgttcgagtggaagtggccggacatcgcggaggaat
gcgagaacgtgctggggccggcgggctacgaggcggtgcaggtgtcgccgccgcaggagcacctggtgcagcaggggggcgccgtggtg
gcagcggtaccagccggtgagctactcggtggcgctgagccgcagcggcacgggcgtggagttcagcaacatgatcagccggtgcaaggc
cgccggcgtggacatctacgtggacgccgtcatcaaccacatgacggccggtgcggggacggggagcaacggcaccgcctacaccaagta
caactaccccggcctgtacgcgcaggcggactttcaccgcagtgcgcggtgggcgactacaccagcgccgccaacgtgcaggactgcga
actgctggggctggctgacctgaacaccggcgcggccggcgtgcagcagaagatcgcggactacctggtctcgctggcgcggctgggcgt
ggcgggttttcgcatcgacgccgccaagcacatccagccggtggaactggacgccatcgtggaccgcgtgaaccagacgctggcggcgga
ggggcgccccgcttccctactggttcgccgaggtgatcgacaacggcggcgagggggtgcggcgcgagcactactacggcctgggatacgg
caccggcggcgccgcggacatcacggagttccgctacaagggcgtgggcgacaagttcctgggcagcggcggccagcggctggtggacc
tgaagaacttctcggcggtgacgtggaacctgatgccgtcggacaaggccgtcgtctttctggagaaccacgatacgcagcgcggcggcggc
atcggctaccgcgatggcacggcgttccggctggccaacgtgtggatgctggcgcagccgtacggctatccgtcggtgatgtccagctacgc
ctttgaccgcacctcccccctttggccgcgacgccggcccgccctccgaggacggcgcgacgaaggacgtgacgtgcgcgcccacgctgga
gacggcggtgctgggcacctgggtgtgcgagcaccgcgaccccgtcattcagcggatggtgggctttcgccgcgcgatggcgggcacgga
cctgaaccgctggtgggacaacggcggcaacgccattgccttttcgcgcggggaccggggcttcgtcgccatcagccgcgagccgaaggtg
accatggcggccgtgcccagcggactgtcccccggcacctactgcgacgtgctgaccggcggcaaggtgggcaacgcctgcgcgggaac
cagcgtgacggtcgactctcagggcgtggtgcagctgagcatcgtcgagaactcggctctggtgatccacctcggggccaagctgtaacggc
gcgctggcggatgtgcggaggg SEQ ID NO: 122
Met Leu Ala Leu Ser Leu Gly Gly Cys Gly Ile Asp Ala Gly Pro Thr Gly Pro Arg Val Val Glu Pro
Leu Pro Gln Arg Pro Thr Leu Pro Gln Glu Tyr Arg Ala Ser Gly His Ala Ala Ala Gly Asp Val Phe
Val His Leu Phe Glu Trp Lys Trp Pro Asp Ile Ala Glu Glu Cys Glu Asn Val Leu Gly Pro Ala Gly
Tyr Glu Ala Val Gln Val Ser Pro Pro Gln Glu His Leu Val Gln Gln Gly Ala Pro Trp Trp Gln Arg
Tyr Gln Pro Val Ser Tyr Ser Val Ala Leu Ser Arg Ser Gly Thr Gly Val Glu Phe Ser Asn Met Ile
Ser Arg Cys Lys Ala Ala Gly Val Asp Ile Tyr Val Asp Ala Val Ile Asn His Met Thr Ala Gly Ala
Gly Thr Gly Ser Asn Gly Thr Ala Tyr Thr Lys Tyr Asn Tyr Pro Gly Leu Tyr Ala Gln Ala Asp Phe
His Pro Gln Cys Ala Val Gly Asp Tyr Thr Ser Ala Ala Asn Val Gln Asp Cys Glu Leu Leu Gly Leu
Ala Asp Leu Asn Thr Gly Ala Ala Gly Val Gln Gln Lys Ile Ala Asp Tyr Leu Val Ser Leu Ala Arg
Leu Gly Val Ala Gly Phe Arg Ile Asp Ala Ala Lys His Ile Gln Pro Val Glu Leu Asp Ala Ile Val
Asp Arg Val Asn Gln Thr Leu Ala Ala Glu Gly Arg Pro Leu Pro Tyr Trp Phe Ala Glu Val Ile Asp
Asn Gly Gly Glu Gly Val Arg Arg Glu His Tyr Tyr Gly Leu Gly Tyr Gly Thr Gly Gly Ala Ala Asp
Ile Thr Glu Phe Arg Tyr Lys Gly Val Gly Asp Lys Phe Leu Gly Ser Gly Gly Gln Arg Leu Val Asp
Leu Lys Asn Phe Ser Ala Val Thr Trp Asn Leu Met Pro Ser Asp Lys Ala Val Val Phe Leu Glu Asn
His Asp Thr Gln Arg Gly Gly Gly Ile Gly Tyr Arg Asp Gly Thr Ala Phe Arg Leu Ala Asn Val Trp
Met Leu Ala Gln Pro Tyr Gly Tyr Pro Ser Val Met Ser Ser Tyr Ala Phe Asp Arg Thr Ser Pro Phe
Gly Arg Asp Ala Gly Pro Pro Ser Glu Asp Gly Ala Thr Lys Asp Val Thr Cys Ala Pro Thr Leu Glu
Thr Ala Val Leu Gly Thr Trp Val Cys Glu His Arg Asp Pro Val Ile Gln Arg Met Val Gly Phe Arg
Arg Ala Met Ala Gly Thr Asp Leu Asn Arg Trp Trp Asp Asn Gly Gly Asn Ala Ile Ala Phe Ser Arg
Gly Asp Arg Gly Phe Val Ala Ile Ser Arg Glu Pro Lys Val Thr Met Ala Ala Val Pro Ser Gly Leu
Ser Pro Gly Thr Tyr Cys Asp Val Leu Thr Gly Gly Lys Val Gly Asn Ala Cys Ala Gly Thr Ser Val
Thr Val Asp Ser Gln Gly Val Val Gln Leu Ser Ile Val Glu Asn Ser Ala Leu Val Ile His Leu Gly
Ala Lys Leu Arg Arg Ala Gly Gly Cys Ala Glu

Figure 16VV

SEQ ID NO: 123 atgccccaggccattcgcacttttcacgttggacgttgttcggcttaatcggcgtttttctgcttggtctcgtcttttctgtcccaccccgggcaatcc
aggcccagacaaccccggcccgtaccgttatggttcacctcttcgagtggaaatggaccgacatcgctaaagaatgcgagaatttcctcggac
cgaaaggctttgccgcaatccaggtatcgccgccccaggagcatgtccagggggtcgcaatggtggacccgctatcagccggtcagctacaag
atcgagagccgctccggcacccgggccgagttcgccaatatggtctcgcgctgcaaagccgtcggggtcgatatctatgtcgatgccgtgatc
aaccatatgacgactgtcggctccggcactggtatggctggatcgacctacaccagctacacctatccggggctgtatcagacccaggacttcc
accactgcgggcgcaatggcaacgatgatatcagcagctacggcgatcgctgggaagtacaaaactgcgaactgctcaacctagccgacctc
aacaccggcgctgagtatgtccggggtaaactcgccgcctatatgaacgatctgcgcggcctgggcgtcgccggatttcggatcgatgccgcc
aagcacatggataccaacgacatcaacaatatcgttggccgcctgcccaacgcgccctacatctaccaggaagtgatcgaccagggcggcga
gccaattaccgccggcgaatacttccagaatggcgatgtgaccgagttcaagtacagccgcgagatctcgcgcatgttcaaaaccggccagct
gacccatatgagccagttcggcactgcctggggcttcatgtccagcgacctggcagtagttttcaccgataaccacgacaaccagcgcggtca
cggcggcgccggcgatgtcttgacctacaaagatggccagctgtacaccctgggcaatatcttcgagctagcctggccgtatggctacccaca
ggtcatgtcgagctacacgttcagcaacggcgaccaggggccgccatcgaccaatgtgtacgcaaccacaacgcctgattgtggcaacggcc
gctgggtctgtgagcaccgctggcgaggaatcgccaacatggtcgcgttccgcaactacaccgccccgaccttcagcaccagcaactggtgg
agcaacggcaacaaccagatcgctttcagccgcgggacctgggctttgtggcgatcaatcgggaaggtggcagcctgaaccgcaccttcca
aaccggcctgccgtcggcacctactgcgatgtcattcacggcgatttcaatgccagcgccggcacctgttccggcccaactatcgctgtcaac
ggctccggacaggcaaccatcacggtcaacgcgatggacgcggtggcgatctacggcggagccaggctcgccactccggccagtgtcaac
gtgacattcaacgaaaacgccacgaccacctggggcagaatgtgtatatcgtcggcaacgtcgccgccctgggcagctggaacgcaggca
gcgcggtcttactctcctccgctaactacccaatctggagcaagaccatcgccctgccagccaacaccgccattgagtacaagtacatcaaaa
ggatggcgcgggcaatgtggtgtgggaaagcggcgccaaccgcgtctttaccaccccggcagcggcagtgccacgcgcaacgatacctg
gaaatag

SEQ ID NO: 124

Met Pro Gln Ala Ile Arg Thr Phe Ser Arg Trp Thr Leu Phe Gly Leu Ile Gly Val Phe Leu Leu Gly
Leu Val Phe Ser Val Pro Pro Arg Ala Ile Gln Ala Gln Thr Thr Pro Ala Arg Thr Val Met Val His
Leu Phe Glu Trp Lys Trp Thr Asp Ile Ala Lys Glu Cys Glu Asn Phe Leu Gly Pro Lys Gly Phe Ala
Ala Ile Gln Val Ser Pro Pro Gln Glu His Val Gln Gly Ser Gln Trp Trp Thr Arg Tyr Gln Pro Val Ser
Tyr Lys Ile Glu Ser Arg Ser Gly Thr Arg Ala Glu Phe Ala Asn Met Val Ser Arg Cys Lys Ala Val
Gly Val Asp Ile Tyr Val Asp Ala Val Ile Asn His Met Thr Thr Val Gly Ser Gly Thr Gly Met Ala
Gly Ser Thr Tyr Thr Ser Tyr Thr Tyr Pro Gly Leu Tyr Gln Thr Gln Asp Phe His His Cys Gly Arg
Asn Gly Asn Asp Asp Ile Ser Ser Tyr Gly Asp Arg Trp Glu Val Gln Asn Cys Glu Leu Leu Asn
Leu Ala Asp Leu Asn Thr Gly Ala Glu Tyr Val Arg Gly Lys Leu Ala Ala Tyr Met Asn Asp Leu
Arg Gly Leu Gly Val Ala Gly Phe Arg Ile Asp Ala Ala Lys His Met Asp Thr Asn Asp Ile Asn Asn
Ile Val Gly Arg Leu Pro Asn Ala Pro Tyr Ile Tyr Gln Glu Val Ile Asp Gln Gly Gly Glu Pro Ile Thr
Ala Gly Glu Tyr Phe Gln Asn Gly Asp Val Thr Glu Phe Lys Tyr Ser Arg Glu Ile Ser Arg Met Phe
Lys Thr Gly Gln Leu Thr His Met Ser Gln Phe Gly Thr Ala Trp Gly Phe Met Ser Ser Asp Leu Ala
Val Val Phe Thr Asp Asn His Asp Asn Gln Arg Gly His Gly Gly Ala Gly Asp Val Leu Thr Tyr
Lys Asp Gly Gln Leu Tyr Thr Leu Gly Asn Ile Phe Glu Leu Ala Trp Pro Tyr Gly Tyr Pro Gln Val
Met Ser Ser Tyr Thr Phe Ser Asn Gly Asp Gln Gly Pro Pro Ser Thr Asn Val Tyr Ala Thr Thr Thr
Pro Asp Cys Gly Asn Gly Arg Trp Val Cys Glu His Arg Trp Arg Gly Ile Ala Asn Met Val Ala Phe
Arg Asn Tyr Thr Ala Pro Thr Phe Ser Thr Ser Asn Trp Trp Ser Asn Gly Asn Asn Gln Ile Ala Phe
Ser Arg Gly Thr Leu Gly Phe Val Ala Ile Asn Arg Glu Gly Gly Ser Leu Asn Arg Thr Phe Gln Thr
Gly Leu Pro Val Gly Thr Tyr Cys Asp Val Ile His Gly Asp Phe Asn Ala Ser Ala Gly Thr Cys Ser
Gly Pro Thr Ile Ala Val Asn Gly Ser Gly Gln Ala Thr Ile Thr Val Asn Ala Met Asp Ala Val Ala Ile
Tyr Gly Gly Ala Arg Leu Ala Thr Pro Ala Ser Val Asn Val Thr Phe Asn Glu Asn Ala Thr Thr Thr
Trp Gly Gln Asn Val Tyr Ile Val Gly Asn Val Ala Ala Leu Gly Ser Trp Asn Ala Gly Ser Ala Val
Leu Leu Ser Ser Ala Asn Tyr Pro Ile Trp Ser Lys Thr Ile Ala Leu Pro Ala Asn Thr Ala Ile Glu Tyr
Lys Tyr Ile Lys Lys Asp Gly Ala Gly Asn Val Val Trp Glu Ser Gly Ala Asn Arg Val Phe Thr Thr
Pro Gly Ser Gly Ser Ala Thr Arg Asn Asp Thr Trp Lys

Figure 16WW

SEQ ID NO: 125
gtggtgcacatgaagttgaagtaccttgccttagttttgttggctgtggcttcgataggcctactctcgactccagtgggtgctgccaagtactccg
aactcgaagagggcggtgttataatgcaggccttctactgggatgttcccggaggggggaatctggtgggacaccataagacagaaaatcccg
gagtggtacgacgctggaatctcggcgatatggattcctccagctagcaaagggatgggcggtggttattccatgggctacgatccctacgattt
ctttgacctcggcgagtactatcagaagggaacagttgagacgcgcttcggctcaaaggaggaactggtgaacatgataaacaccgcacactc
ctatggcataaaggtgatagcggacatagtcataaaccaccgcgccggtggagaccttgagtggaaccccttgtaaacaactatacttggaca
gacttctccaaggtcgcctccggtaaatacacggccaactaccttgacttcacccaaacgaggtcaagtgctgcgatgagggtacatttggtga
ctttccggacatcgcccacgagaagagctgggatcagtactggctctgggcaagcaatgagagctacgccgcatatctccggagcataggga
tcgatgcatggcgtttcgactacgtcaaaggttacggagcgtgggttgttaatgactggctcagctggtggggaggctgggccgttggagagta
ctgggacacgaacgttgatgcactccttaactgggcatacgacagcggtgccaaggtctttgacttcccgctctactacaagatggacgaagcc
tttgacaacaccaacatcccgctttggttacgccctccagaacggaggaacagtcgtttcccgcgatcccttcaaggcagtaactttcgttgcc
aaccacgatacagatataatctggaacaagtatccggcttatgcgttcatccttacctatgagggacagcctgttatattttaccgcgactacgagg
agtggctcaacaaggataagcttaacaaccttatctggatacacgagcaccttgccggaggaagtaccaagatcctctactacgataacgatga
gctaatattcatgagggagggctacgggagcaagccgggcctcataacctacataaacctcggaaacgactgggccgagcgctgggtgaac
gtcggctcaaagtttgccggctacacaatccatgaatacacaggcaatctcggtggctgggttgacaggtgggttcagtacgatggatgggtta
aactgacggcacctcctcatgatccagccaacggatattacggctactcagtctggagctacgcaggcgtcggatga SEQ ID NO: 126
Val Val His Met Lys Leu Lys Tyr Leu Ala Leu Val Leu Leu Ala Val Ala Ser Ile Gly Leu Leu Ser
Thr Pro Val Gly Ala Ala Lys Tyr Ser Glu Leu Glu Glu Gly Gly Val Ile Met Gln Ala Phe Tyr Trp
Asp Val Pro Gly Gly Gly Ile Trp Trp Asp Thr Ile Arg Gln Lys Ile Pro Glu Trp Tyr Asp Ala Gly Ile
Ser Ala Ile Trp Ile Pro Pro Ala Ser Lys Gly Met Gly Gly Gly Tyr Ser Met Gly Tyr Asp Pro Tyr
Asp Phe Phe Asp Leu Gly Glu Tyr Tyr Gln Lys Gly Thr Val Glu Thr Arg Phe Gly Ser Lys Glu Glu
Leu Val Asn Met Ile Asn Thr Ala His Ser Tyr Gly Ile Lys Val Ile Ala Asp Ile Val Ile Asn His Arg
Ala Gly Gly Asp Leu Glu Trp Asn Pro Phe Val Asn Asn Tyr Thr Trp Thr Asp Phe Ser Lys Val Ala
Ser Gly Lys Tyr Thr Ala Asn Tyr Leu Asp Phe His Pro Asn Glu Val Lys Cys Cys Asp Glu Gly Thr
Phe Gly Asp Phe Pro Asp Ile Ala His Glu Lys Ser Trp Asp Gln Tyr Trp Leu Trp Ala Ser Asn Glu
Ser Tyr Ala Ala Tyr Leu Arg Ser Ile Gly Ile Asp Ala Trp Arg Phe Asp Tyr Val Lys Gly Tyr Gly
Ala Trp Val Val Asn Asp Trp Leu Ser Trp Trp Gly Gly Trp Ala Val Gly Glu Tyr Trp Asp Thr Asn
Val Asp Ala Leu Leu Asn Trp Ala Tyr Asp Ser Gly Ala Lys Val Phe Asp Phe Pro Leu Tyr Tyr Lys
Met Asp Glu Ala Phe Asp Asn Thr Asn Ile Pro Ala Leu Val Tyr Ala Leu Gln Asn Gly Gly Thr Val
Val Ser Arg Asp Pro Phe Lys Ala Val Thr Phe Val Ala Asn His Asp Thr Asp Ile Ile Trp Asn Lys
Tyr Pro Ala Tyr Ala Phe Ile Leu Thr Tyr Glu Gly Gln Pro Val Ile Phe Tyr Arg Asp Tyr Glu Glu
Trp Leu Asn Lys Asp Lys Leu Asn Asn Leu Ile Trp Ile His Glu His Leu Ala Gly Gly Ser Thr Lys
Ile Leu Tyr Tyr Asp Asn Asp Glu Leu Ile Phe Met Arg Glu Gly Tyr Gly Ser Lys Pro Gly Leu Ile
Thr Tyr Ile Asn Leu Gly Asn Asp Trp Ala Glu Arg Trp Val Asn Val Gly Ser Lys Phe Ala Gly Tyr
Thr Ile His Glu Tyr Thr Gly Asn Leu Gly Gly Trp Val Asp Arg Trp Val Gln Tyr Asp Gly Trp Val
Lys Leu Thr Ala Pro Pro His Asp Pro Ala Asn Gly Tyr Tyr Gly Tyr Ser Val Trp Ser Tyr Ala Gly
Val Gly SEQ ID NO: 127
gtgtgcatgaattatttgaaaaaagtgtggttgtattacgctatcgtcgctaccttaatcatttactttcttacgcccttttcaactgcacaagccaacac
tgcaccagtcaacggaacgatgatgcaatatttcgaatgggatttaccgaatgatggcacactttggacgaaagtaaaaaacgaagcaagcagt
ctttcttctttaggtattactgcgttatggttaccacctgcatacaaaggaacgagccaagggatgtcgggtatggcgtgtacgatttgtatgactt
aggagaatttaatcaaaaagggacgattcgaacgaaatacggaacaaaaacgcaatatttacaagccattcaagcggcaaaaagcgctggcat
gcaagtatacgctgatgtcgtatttaatcacaaggcgggggcagatagtacagaatggggttgacgcagtcgaagtgaatccttctaatcgaaacc
aagaaacatctggcacatatcaaattcaagcatggacaaaatttgatttccctggccgtgggaacacatactcaagctttaaatggcgatggtatc
atttgacggtacggattgggatgaaagccgaaaactaaatcgtatttacaaatttcgtggcacaggaaaagcatgggattgggaagtagacaca
gagaacggaaactatgactacttaatgtttgctgatttagatatggatcaccctgaagtcgtgacagagctaaaaaactggggaacatggtacgtc aatacgacaaatgtcgatgggtttcgcttagatgcagtaaagcatattaaatatagcttcttcccagattggttaacacatgtgcgttcacaaacacg
aaaaaatcttttgcagtaggagaattttggagctacgatgtcaataaactgcataactacattacaaaaacaagtggaaccatgtcgttatttgatg
cgccacttcataacaactttacactgcttcaaaatctagcgggtattttgacatgcgctatttgttaaataatacgttgatgaaagaccagcctctct
tgcggtcacactcgttgataatcatgacacgcaaccgggacaatctttacaatcatgggtagagccttggtttaagccgcttgcttatgcctttatttt
gacaagacaagaaggatatccttgcgtattttacggcgactattacggcatccctaaatacaacattccgggattgaaaagtaaaatcgatccgct
tctcattgcccgtagagactacgcatacggaacacaacgtgattatattgaccatcaagacattattggatggacacgggaaggaattgactcaa
aaccgaactctggacttgcggctttaattactgacggccctggtggaagtaaatggatgtatgtaggtaaaaagcatgctggaaaagtgttttacg
atctcactggaaatcgaagcgatacggtaacgattaatgcagacggctggggagagtttaaagtaaacggtggctccgtttccatttgggttgcc
aaaacatcacaagtcacgtttaccgtcaacaatgcgacaacgataagcggacaaaatgtgtatgtcgttggtaacattccagagctcggaaattg
gaacacagcaaacgcaatcaaaatgaccccatcttcttatccaacgtggaaagcaaccattgctcttccacaaggaaaagccattgaatttaaatt
tattaaaaaagaccaatcgggaaatgttgtttgggaaagcattccaaaccgaacatacaccgttccatttttatcaacaggctcatatacagctagtt
ggaatgtaccttaa SEQ ID NO: 128
Val Cys Met Asn Tyr Leu Lys Lys Val Trp Leu Tyr Tyr Ala Ile Val Ala Thr Leu Ile Ile Tyr Phe
Leu Thr Pro Phe Ser Thr Ala Gln Ala Asn Thr Ala Pro Val Asn Gly Thr Met Met Gln Tyr Phe Glu
Trp Asp Leu Pro Asn Asp Gly Thr Leu Trp Thr Lys Val Lys Asn Glu Ala Ser Ser Leu Ser Ser Leu
Gly Ile Thr Ala Leu Trp Leu Pro Pro Ala Tyr Lys Gly Thr Ser Gln Gly Asp Val Gly Tyr Gly Val
Tyr Asp Leu Tyr Asp Leu Gly Glu Phe Asn Gln Lys Gly Thr Ile Arg Thr Lys Tyr Gly Thr Lys Thr
Gln Tyr Leu Gln Ala Ile Gln Ala Ala Lys Ser Ala Gly Met Gln Val Tyr Ala Asp Val Val Phe Asn
His Lys Ala Gly Ala Asp Ser Thr Glu Trp Val Asp Ala Val Glu Val Asn Pro Ser Asn Arg Asn Gln
Glu Thr Ser Gly Thr Tyr Gln Ile Gln Ala Trp Thr Lys Phe Asp Phe Pro Gly Arg Gly Asn Thr Tyr
Ser Ser Phe Lys Trp Arg Trp Tyr His Phe Asp Gly Thr Asp Trp Asp Glu Ser Arg Lys Leu Asn Arg
Ile Tyr Lys Phe Arg Gly Thr Gly Lys Ala Trp Asp Trp Glu Val Asp Thr Glu Asn Gly Asn Tyr Asp
Tyr Leu Met Phe Ala Asp Leu Asp Met Asp His Pro Glu Val Val Thr Glu Leu Lys Asn Trp Gly
Thr Trp Tyr Val Asn Thr Thr Asn Val Asp Gly Phe Arg Leu Asp Ala Val Lys His Ile Lys Tyr Ser
Phe Phe Pro Asp Trp Leu Thr His Val Arg Ser Gln Thr Arg Lys Asn Leu Phe Ala Val Gly Glu Phe
Trp Ser Tyr Asp Val Asn Lys Leu His Asn Tyr Ile Thr Lys Thr Ser Gly Thr Met Ser Leu Phe Asp
Ala Pro Leu His Asn Asn Phe Tyr Thr Ala Ser Lys Ser Ser Gly Tyr Phe Asp Met Arg Tyr Leu Leu
Asn Asn Thr Leu Met Lys Asp Gln Pro Ser Leu Ala Val Thr Leu Val Asp Asn His Asp Thr Gln
Pro Gly Gln Ser Leu Gln Ser Trp Val Glu Pro Trp Phe Lys Pro Leu Ala Tyr Ala Phe Ile Leu Thr
Arg Gln Glu Gly Tyr Pro Cys Val Phe Tyr Gly Asp Tyr Tyr Gly Ile Pro Lys Tyr Asn Ile Pro Gly
Leu Lys Ser Lys Ile Asp Pro Leu Leu Ile Ala Arg Arg Asp Tyr Ala Tyr Gly Thr Gln Arg Asp Tyr
Ile Asp His Gln Asp Ile Ile Gly Trp Thr Arg Glu Gly Ile Asp Ser Lys Pro Asn Ser Gly Leu Ala Ala
Leu Ile Thr Asp Gly Pro Gly Gly Ser Lys Trp Met Tyr Val Gly Lys Lys His Ala Gly Lys Val Phe
Tyr Asp Leu Thr Gly Asn Arg Ser Asp Thr Val Thr Ile Asn Ala Asp Gly Trp Gly Glu Phe Lys Val
Asn Gly Gly Ser Val Ser Ile Trp Val Ala Lys Thr Ser Gln Val Thr Phe Thr Val Asn Asn Ala Thr
Thr Ile Ser Gly Gln Asn Val Tyr Val Val Gly Asn Ile Pro Glu Leu Gly Asn Trp Asn Thr Ala Asn
Ala Ile Lys Met Thr Pro Ser Ser Tyr Pro Thr Trp Lys Ala Thr Ile Ala Leu Pro Gln Gly Lys Ala Ile
Glu Phe Lys Phe Ile Lys Lys Asp Gln Ser Gly Asn Val Val Trp Glu Ser Ile Pro Asn Arg Thr Tyr
Thr Val Pro Phe Leu Ser Thr Gly Ser Tyr Thr Ala Ser Trp Asn Val Pro SEQ ID NO: 129
ttgcgttgccgccgtggcagggacgggtgttggtgcgggcggcgtaatgcgctgccgcgacacccgcgtgaacaaaataatatgaattatttg
aataggatgggggtgtcaagaatgacaaaatctcgagagttgcggtgttcatggaaagtatttgttgttgggtgcctgttgtggatggcttgggga
tcttccgcgtccgccggcgtattgatgcaaggcttctactgggacgccagtaccgggaccagtgattcgtggtggacgcatttggccaagcaag
ccaacggtctaaaacgggcggggttcaccgccgtatggattcctccggtgcttaaagggcttcaggggcgctattccaacgggtacgatccctt
tgacgactatgatatcggaagcaaggaccagaaaggtaccgtggcgacgcgatgggggacgcgagaagaactgcaacgtgccgtggccgt
gatgcgcgcgaacggtctggatgtgtatgtggatctggtgctgaaccaccgcaacggggacgacgggaattggaattttcattacaaagatgc
gtacggcaaagtgggttacgggcggtttcaaaaggggttttacgattttcaccccaactacaacattcaggatgccaatgttcccaacgaggattc

Figure 16YY cagcttcgggcgcgatttagcccatgacaatccgtatgtggccgatggactgaaggctgcaggcgattggctgaccaaagccctcgatgttca
gggatatcgtctggattacgtgaaaggcatcagctacaccttcctgaaaagttatctgtcctatggggccatgaacggaaaatttgccgtcggtga
gtactgggatgccaaccgggatacgttgaactggtgggcgaacacggcgatggaagggcgggcccatgtgtttgattttgcgttgcgcgagg
agctgaaaaacatgtgcaatgcggacgggtactacgacatgcgtcgattggaccacgcgggtctggtcggaatcgacccgtggaaggcggt
gacgtttgtcgaaaaccatgatacggatcggcacgacccccatctacaataacaagcatttggcgtatgcctacatcttgacgtcggaagggtatc
cgacggtgttctggaaggattactaccaatacggaatgaagccgatcatcgacaacctcatttggatccacgaacacattgcgtacggaacgac
ccaagagcgttggaaagacgaagatgtctttgtgtatgagcggaccggaggcaagcggctattggtggggcttaacgacaatcgcgccacca
gcaaaacggtcaccgtacagaccggctttggtgccaacgtggccttgcacgactacaccggcaacggcccgatctccgtaccgacgcctac
ggtcgggtaaccttgaccattcctgcaaacgggtacgtggcctattccgttccgggcatctccggatcctttgtgccggtcgagaaaaccgtgac
gcaggagtttgccggggcgtccgacttggatattcgtccggccgataacacgcaatttgtgcaggtcgggcggatatacgccaaggcaaacaa
gccggttacagcggaattgtattgggatgccaaagactggacgacctccacgtcgattctcctagaagtgcgttcggcttcgggaacgctcatc
acgacaaagaccgtgacccaattgtcgtcccagggtacccgcgtttccttcacgccttcggctaccggatggtacgtcttttccattcgaagctat
aacacgccttcgacgaacccaaagccggcctactggttaaaggtaacgtatacggcgccgcaattgcttcagtaa SEQ ID NO: 130
Met Arg Cys Arg Arg Gly Arg Asp Gly Cys Trp Cys Gly Arg Arg Asn Ala Leu Pro Arg His Pro
Arg Glu Gln Asn Asn Met Asn Tyr Leu Asn Arg Met Gly Val Ser Arg Met Thr Lys Ser Arg Glu
Leu Arg Cys Ser Trp Lys Val Phe Val Val Gly Cys Leu Leu Trp Met Ala Trp Gly Ser Ser Ala Ser
Ala Gly Val Leu Met Gln Gly Phe Tyr Trp Asp Ala Ser Thr Gly Thr Ser Asp Ser Trp Trp Thr His
Leu Ala Lys Gln Ala Asn Gly Leu Lys Arg Ala Gly Phe Thr Ala Val Trp Ile Pro Pro Val Leu Lys
Gly Ala Ser Gly Gly Tyr Ser Asn Gly Tyr Asp Pro Phe Asp Asp Tyr Asp Ile Gly Ser Lys Asp Gln
Lys Gly Thr Val Ala Thr Arg Trp Gly Thr Arg Glu Glu Leu Gln Arg Ala Val Ala Val Met Arg Ala
Asn Gly Leu Asp Val Tyr Val Asp Leu Val Leu Asn His Arg Asn Gly Asp Asp Gly Asn Trp Asn
Phe His Tyr Lys Asp Ala Tyr Gly Lys Val Gly Tyr Gly Arg Phe Gln Lys Gly Phe Tyr Asp Phe His
Pro Asn Tyr Asn Ile Gln Asp Ala Asn Val Pro Asn Glu Asp Ser Ser Phe Gly Arg Asp Leu Ala His
Asp Asn Pro Tyr Val Ala Asp Gly Leu Lys Ala Ala Gly Asp Trp Leu Thr Lys Ala Leu Asp Val
Gln Gly Tyr Arg Leu Asp Tyr Val Lys Gly Ile Ser Tyr Thr Phe Leu Lys Ser Tyr Leu Ser Tyr Gly
Ala Met Asn Gly Lys Phe Ala Val Gly Glu Tyr Trp Asp Ala Asn Arg Asp Thr Leu Asn Trp Trp
Ala Asn Thr Ala Met Glu Gly Arg Ala His Val Phe Asp Phe Ala Leu Arg Glu Glu Leu Lys Asn
Met Cys Asn Ala Asp Gly Tyr Tyr Asp Met Arg Arg Leu Asp His Ala Gly Leu Val Gly Ile Asp
Pro Trp Lys Ala Val Thr Phe Val Glu Asn His Asp Thr Asp Arg His Asp Pro Ile Tyr Asn Asn Lys
His Leu Ala Tyr Ala Tyr Ile Leu Thr Ser Glu Gly Tyr Pro Thr Val Phe Trp Lys Asp Tyr Tyr Gln
Tyr Gly Met Lys Pro Ile Ile Asp Asn Leu Ile Trp Ile His Glu His Ile Ala Tyr Gly Thr Thr Gln Glu
Arg Trp Lys Asp Glu Asp Val Phe Val Tyr Glu Arg Thr Gly Gly Lys Arg Leu Leu Val Gly Leu
Asn Asp Asn Arg Ala Thr Ser Lys Thr Val Thr Val Gln Thr Gly Phe Gly Ala Asn Val Ala Leu His
Asp Tyr Thr Gly Asn Gly Pro Asp Leu Arg Thr Asp Ala Tyr Gly Arg Val Thr Leu Thr Ile Pro Ala
Asn Gly Tyr Val Ala Tyr Ser Val Pro Gly Ile Ser Gly Ser Phe Val Pro Val Glu Lys Thr Val Thr
Gln Glu Phe Ala Gly Ala Ser Asp Leu Asp Ile Arg Pro Ala Asp Asn Thr Gln Phe Val Gln Val Gly
Arg Ile Tyr Ala Lys Ala Asn Lys Pro Val Thr Ala Glu Leu Tyr Trp Asp Ala Lys Asp Trp Thr Thr
Ser Thr Ser Ile Leu Leu Glu Val Arg Ser Ala Ser Gly Thr Leu Ile Thr Thr Lys Thr Val Thr Gln Leu
Ser Ser Gln Gly Thr Arg Val Ser Phe Thr Pro Ser Ala Thr Gly Trp Tyr Val Phe Ser Ile Arg Ser Tyr
Asn Thr Pro Ser Thr Asn Pro Lys Pro Ala Tyr Trp Leu Lys Val Thr Tyr Thr Ala Pro Gln Leu Leu
Gln SEQ ID NO: 131
atgccgcagctttacccattgccgccgcgctggcggcgcgcggcccggcagggcctggccgccttgacgctggccaccacggccctgggc
atctcgacggcccaggcccagagtgcaccgcgcacggccttcgtgcatctgttcgaatggaagtggaccgacatcgcgcgcgagtgcgaga
ccttcctcgggcccaagggcttcgcggcggtgcaggtgtcgcccccgaacgagcacaactgggtgaccagcggtgatggtgcaccttatccg
tggtggatgcgctaccagccggtgagctacagcctggaccgcagccgcagcggcacgcgcgccgagttccaggacatggtcaaccgatgc
aatgccgtgggcgtgggcatctacgtggacgccgtgatcaatcacatgtccggcggcacgggcggcacctcgagcgctgggcgcagctgg

Figure 16ZZ agctatcacaactaccctgggctctatggccccaacgacttccaccagccggtgtgcagcatcaccaactacggggatgcgaacaatgtgcag
cgttgcgagctctcgggcttgcaggacctggacactgggagcgcttatgtgcgcggcaagatcgccgactatctggtggatctggtcaacatg
ggggtcaagggcttccgggtggatgcggccaagcacatcagcccgaccgacctggcgccatcatcgatgcggtcaacagccgcaccggc
gcgaaccgcccttctggtttctggaggtgattggcgcggccggcgaggcagtgcagccgaaccagtacttctcgctcggcggcggccaggt
caccgtgaccgagttcaactatgggaagcaaatcttcggcaagttcgccggtggcggccgtctggccgagctgcgcagcttcggtgaaacctg
gggcctgatgcccagcagcaaagcgattgctttcatcgacaaccacgacaagcagcgcggtcatggcggcggtggcaactatctgacctacc
accatggctcgacctacgatctggccaacatcttcatgctggcttggccttatggctaccggcgctgatgtccagctatgccttcaaccgcagc
acggcctacgacacgagctttggcccgccacacgacagtggtggcgccaccgtggccctgggatggtggcggcagccagccggcctgc
ttcaaccagagcatcggtggctgggtgtgtgagcaccgctggcggggcatcgccaatatggtggccttccgcaacgccacgctgcccaactg
gaccgtgaccgactggtgggacaacggcaacaaccagatcgctttcgggcgggtgacaagggcttcgtggtgatcaaccgcgaagacgc
cgcgctgacgcgcaacttcaagaccagcctgccagccggccagtactgcgatgtcatctccggggacttcaacaatggtcagtgcacgggcc
atgtggtgacggtcgatgccggcggctacgtgacgctgacggccgggcccaatggtgcggcggccatccacgtgggcgcccgtctggacg
gcgcctctcagccgccgacgaccgcctcggtgacgttcaacgcgtcggccgatacctttggggacagaacctgttcgtcgtgggcaaccaca
gcgcactgggcaactggtcgccggcggccgccaggccgatgacttggatttccggttcgggcacgcgcgggaactggcgcgcggtgctca
atttgccggccaataccacctaccaatacaagttcatcaagaaggacggggctggaaacgtggtttgggagggcggtggcaatcgcgtcgtga
ccacgccgtctgggggcggatcggtgagcacgggcggcaattggcagtag SEQ ID NO: 132
Met Pro Gln Leu Tyr Pro Leu Pro Pro Arg Trp Arg Arg Ala Ala Arg Gln Gly Leu Ala Ala Leu Thr
Leu Ala Thr Thr Ala Leu Gly Ile Ser Thr Ala Gln Ala Gln Ser Ala Pro Arg Thr Ala Phe Val His
Leu Phe Glu Trp Lys Trp Thr Asp Ile Ala Arg Glu Cys Glu Thr Phe Leu Gly Pro Lys Gly Phe Ala
Ala Val Gln Val Ser Pro Pro Asn Glu His Asn Trp Val Thr Ser Gly Asp Gly Ala Pro Tyr Pro Trp
Trp Met Arg Tyr Gln Pro Val Ser Tyr Ser Leu Asp Arg Ser Arg Ser Gly Thr Arg Ala Glu Phe Gln
Asp Met Val Asn Arg Cys Asn Ala Val Gly Val Gly Ile Tyr Val Asp Ala Val Ile Asn His Met Ser
Gly Gly Thr Gly Gly Thr Ser Ser Ala Gly Arg Ser Trp Ser Tyr His Asn Tyr Pro Gly Leu Tyr Gly
Pro Asn Asp Phe His Gln Pro Val Cys Ser Ile Thr Asn Tyr Gly Asp Ala Asn Asn Val Gln Arg Cys
Glu Leu Ser Gly Leu Gln Asp Leu Asp Thr Gly Ser Ala Tyr Val Arg Gly Lys Ile Ala Asp Tyr Leu
Val Asp Leu Val Asn Met Gly Val Lys Gly Phe Arg Val Asp Ala Ala Lys His Ile Ser Pro Thr Asp
Leu Gly Ala Ile Ile Asp Ala Val Asn Ser Arg Thr Gly Ala Asn Arg Pro Phe Trp Phe Leu Glu Val
Ile Gly Ala Ala Gly Glu Ala Val Gln Pro Asn Gln Tyr Phe Ser Leu Gly Gly Gly Gln Val Thr Val
Thr Glu Phe Asn Tyr Gly Lys Gln Ile Phe Gly Lys Phe Ala Gly Gly Gly Arg Leu Ala Glu Leu Arg
Ser Phe Gly Glu Thr Trp Gly Leu Met Pro Ser Ser Lys Ala Ile Ala Phe Ile Asp Asn His Asp Lys
Gln Arg Gly His Gly Gly Gly Gly Asn Tyr Leu Thr Tyr His His Gly Ser Thr Tyr Asp Leu Ala Asn
Ile Phe Met Leu Ala Trp Pro Tyr Gly Tyr Pro Ala Leu Met Ser Ser Tyr Ala Phe Asn Arg Ser Thr
Ala Tyr Asp Thr Ser Phe Gly Pro Pro His Asp Ser Gly Gly Ala Thr Arg Gly Pro Trp Asp Gly Gly
Gly Ser Gln Pro Ala Cys Phe Asn Gln Ser Ile Gly Gly Trp Val Cys Glu His Arg Trp Arg Gly Ile
Ala Asn Met Val Ala Phe Arg Asn Ala Thr Leu Pro Asn Trp Thr Val Thr Asp Trp Trp Asp Asn
Gly Asn Asn Gln Ile Ala Phe Gly Arg Gly Asp Lys Gly Phe Val Val Ile Asn Arg Glu Asp Ala Ala
Leu Thr Arg Asn Phe Lys Thr Ser Leu Pro Ala Gly Gln Tyr Cys Asp Val Ile Ser Gly Asp Phe Asn
Asn Gly Gln Cys Thr Gly His Val Val Thr Val Asp Ala Gly Gly Tyr Val Thr Leu Thr Ala Gly Pro
Asn Gly Ala Ala Ala Ile His Val Gly Ala Arg Leu Asp Gly Ala Ser Gln Pro Pro Thr Thr Ala Ser
Val Thr Phe Asn Ala Ser Ala Asp Thr Phe Trp Gly Gln Asn Leu Phe Val Val Gly Asn His Ser Ala
Leu Gly Asn Trp Ser Pro Ala Ala Ala Arg Pro Met Thr Trp Ile Ser Gly Ser Gly Thr Arg Gly Asn
Trp Arg Ala Val Leu Asn Leu Pro Ala Asn Thr Thr Tyr Gln Tyr Lys Phe Ile Lys Lys Asp Gly Ala
Gly Asn Val Val Trp Glu Gly Gly Gly Asn Arg Val Val Thr Thr Pro Ser Gly Gly Gly Ser Val Ser
Thr Gly Gly Asn Trp Gln SEQ ID NO: 133
atgaataatgtgaaaaaagtatggttgtattattctataattgctaccttagttatttcctttttcacacctttttcaacagcacaagctaatactgcacctg
tcaacggaacaatgatgcaatatttcgaatgggatttaccgaatgatgggacgctttggacgaaagtaaaaaatgaagctaccaatctttcttcgct

Figure 16AAA aggtattacagcgttatggctccctccagcatataaaggaacgagccaaagcgatgtcggatatggcgtgtacgatttatatgaccttggggaatt
taatcaaaaagggacgatccgaacgaaatacggaacaaaagcacaatatattcaagccatccaagctgccaaagccgcagggatgcaagtat
atgcagatgttgtatttaatcataaggcgggggctgacggcacagaatttgtcgatgcagttgaggtaaaccttctaatcgaaatcaagaaacat
ctggcacatatcaaattcaagcatggacaaaatttgattttcctggtcgtggaaacacatactccagcttcaaatggcgctggtatcattttgacggt
accgattgggatgaaagtcgtaaattaaatcgtatttacaaattccgcggtacaggaaaagcgtgggactgggaagtcgatacagaaaacgga
aactatgattatttaatgttcgctgatttagatatggatcaccctgaagttgtgacagagttaaaaaactggggaaaatggtatgtaaatacgacaaa
tgtagacggatttcgtttggatgccgtaaaacatattaaatacagcttttcctgactggctaacatatgtacgtaatcaaacaggaaaaaatttattt
gctgttggggaattttggagctatgacgtcaataagctgcataactacattacaaaaacaaatggatcgatgtcgttatttgatgcacctttgcataa
caactttatatcgcttccaaatcgagtggatatttgacatgcgttatttattgaataatacattaatgaaagatcaaccttcactcgctgtaacacttgt
cgataaccatgatacacaaccaggtcaatctttacaatcatgggtagaagcttggtttaaaccgcttgcttacgcctttatttaacaagacaagag
gggtatccttgcgtattttacggtgactattacggaatcccgaaatacaatattccgggattaaaaagtaaaattgatccgcttttaattgctcgtcgt
gattatgcttatggaacacaacgtgattacattgatcatcaagacattatcggatggacacgagaaggcattgatgcaaaaccgaactctggactt
gcggctttaattaccgacggccctggcggaagtaaatggatgtatgtcggtaaaaaacatgctgggaaagtgttttatgatttaactggaaatcga
agtgacacagtaacgattaatgcggacggttggggagaatttaaagtaaacggcggctccgtttcgatttgggtggctaaaacatcaaacgtca
catttacagtcaataacgccacaacaacaagtggacaaaacgtatatgttgttggcaacattccagagctaggcaattctttg SEQ ID NO: 134
Met Asn Asn Val Lys Lys Val Trp Leu Tyr Tyr Ser Ile Ile Ala Thr Leu Val Ile Ser Phe Phe Thr Pro
Phe Ser Thr Ala Gln Ala Asn Thr Ala Pro Val Asn Gly Thr Met Met Gln Tyr Phe Glu Trp Asp Leu
Pro Asn Asp Gly Thr Leu Trp Thr Lys Val Lys Asn Glu Ala Thr Asn Leu Ser Ser Leu Gly Ile Thr
Ala Leu Trp Leu Pro Pro Ala Tyr Lys Gly Thr Ser Gln Ser Asp Val Gly Tyr Gly Val Tyr Asp Leu
Tyr Asp Leu Gly Glu Phe Asn Gln Lys Gly Thr Ile Arg Thr Lys Tyr Gly Thr Lys Ala Gln Tyr Ile
Gln Ala Ile Gln Ala Ala Lys Ala Ala Gly Met Gln Val Tyr Ala Asp Val Val Phe Asn His Lys Ala
Gly Ala Asp Gly Thr Glu Phe Val Asp Ala Val Glu Val Asn Pro Ser Asn Arg Asn Gln Glu Thr Ser
Gly Thr Tyr Gln Ile Gln Ala Trp Thr Lys Phe Asp Phe Pro Gly Arg Gly Asn Thr Tyr Ser Ser Phe
Lys Trp Arg Trp Tyr His Phe Asp Gly Thr Asp Trp Asp Glu Ser Arg Lys Leu Asn Arg Ile Tyr Lys
Phe Arg Gly Thr Gly Lys Ala Trp Asp Trp Glu Val Asp Thr Glu Asn Gly Asn Tyr Asp Tyr Leu
Met Phe Ala Asp Leu Asp Met Asp His Pro Glu Val Val Thr Glu Leu Lys Asn Trp Gly Lys Trp
Tyr Val Asn Thr Thr Asn Val Asp Gly Phe Arg Leu Asp Ala Val Lys His Ile Lys Tyr Ser Phe Phe
Pro Asp Trp Leu Thr Tyr Val Arg Asn Gln Thr Gly Lys Asn Leu Phe Ala Val Gly Glu Phe Trp Ser
Tyr Asp Val Asn Lys Leu His Asn Tyr Ile Thr Lys Thr Asn Gly Ser Met Ser Leu Phe Asp Ala Pro
Leu His Asn Asn Phe Tyr Ile Ala Ser Lys Ser Ser Gly Tyr Phe Asp Met Arg Tyr Leu Leu Asn Asn
Thr Leu Met Lys Asp Gln Pro Ser Leu Ala Val Thr Leu Val Asp Asn His Asp Thr Gln Pro Gly Gln
Ser Leu Gln Ser Trp Val Glu Ala Trp Phe Lys Pro Leu Ala Tyr Ala Phe Ile Leu Thr Arg Gln Glu
Gly Tyr Pro Cys Val Phe Tyr Gly Asp Tyr Tyr Gly Ile Pro Lys Tyr Asn Ile Pro Gly Leu Lys Ser
Lys Ile Asp Pro Leu Leu Ile Ala Arg Arg Asp Tyr Ala Tyr Gly Thr Gln Arg Asp Tyr Ile Asp His
Gln Asp Ile Ile Gly Trp Thr Arg Glu Gly Ile Asp Ala Lys Pro Asn Ser Gly Leu Ala Ala Leu Ile Thr
Asp Gly Pro Gly Gly Ser Lys Trp Met Tyr Val Gly Lys Lys His Ala Gly Lys Val Phe Tyr Asp Leu
Thr Gly Asn Arg Ser Asp Thr Val Thr Ile Asn Ala Asp Gly Trp Gly Glu Phe Lys Val Asn Gly Gly
Ser Val Ser Ile Trp Val Ala Lys Thr Ser Asn Val Thr Phe Thr Val Asn Asn Ala Thr Thr Thr Ser
Gly Gln Asn Val Tyr Val Val Gly Asn Ile Pro Glu Leu Gly Asn Ser Leu SEQ ID NO: 135
gtgacaggcaccccgtctttatacattcctccacataaaataaccatacagctttcaaatttgttgaaatgtataaaaataaaaaatagtattgtaagc
gttaacatccgtcattataataacttcaaacgcgtttatgttttaatgcaaacgtttgcatcctcatttatttaaagaaaggatgtgtgtgcatgaattatt
tgaaaaaagtgtggttgtattacgctatcgtcgctaccttaatcatttcctttcttacgcccttttcaactgcacaagccaacactgcaccagtcaacg
gaacgatgatgcaatatttcgaatgggatttaccgaatgatggcacactttggacgaaagtaaaaaaacgaagcaagcagcctttcttctttaggtat
tactgcgttatggttaccacctgcatacaaaggaacgagccaaggggatgtcgggtatggcgtgtacgatttgtatgacttaggagaatttaatca
aaaagggacgattcgaacgaaatacggaacaaaaacgcaatatttacaagccattcaagcggcaaaaagcgctggcatgcaagtatacgctg
atgtcgtatttaatcacaaggcggggggcagatagtacagaatgggttgacgcagtcgaagtgaatccttctaatcgaaaccaagaaacatctgg

Figure 16BBB cacatatcaaattcaagcatggacaaaatttgatttccctgaccgtgggaacacatactcaagctttaaatggcgctggtatcattttgacggtacg
gattgggatgaaagtcgaaaactaaatcgcatttacaaatttcgtggcacaggaaaagcatgggattgggaagtagacacagagaacggaaac
tatgactacttaatgtttgctgatttagatatggatcaccctgaagtcgtgacagagctaaaaaactggggaacatggtacgtcaatacgacaaatg
tcgatgggtttcgcttagatgcagtaaagcatattaaatatagcttttccagattggttaacatatgtgcgctcacaaacacaaaaaatctgtttg
cagtaggagaattttggagctacgatgtcaataaactgcataactacattacaaaaacaagtggaaccatgtcgttatttgatgcgccacttcataa
caacttttacactgcttcaaaatctagcgggtattttgacatgcgctatttgttaaataatacgttgatgaaagaccagccttctcttgcggtcacactc
gttgataatcatgacacgcaaccgggacaatctttacaatcatgggtagagccttggtttaagccgcttgcttatgcctttattttgacaagacaaga
aggatatccttgcgtattttacggcgactattacggcatccctaaatacaatattccgggattgaaaagtaaaatcgatccgcttctcattgcccgta
gagactacgcatacggaacacaacgtgattatattgaccatcaagacattattggatggacacgggaaggaattgactcaaaaccgaactctgg
acttgcggctttaattactgacggtcctggtggaagtaaatggatgtatgtaggtaaaaagcatgctggaaaagtgttttacgatctcactggaaat
cgaagcgatacggtaacgattaatgcagacggctggggagagtttaaagtaaacggtggctccgtttccatttgggttgccaaaacatcacaag
tcacgtttaccgtcaacaatgcgacaacgacaagcggacaaaatgtgtatgtcgttggcaacattccagagctcggaaattggaacacagcaaa
cgcaatcaaaatgaccccatcttcttatccaacgtggaaaacaaccattgctcttccacaaggaaaagcaattggcggcgtacgccatggcccctt
ga SEQ ID NO: 136
Val Thr Gly Thr Pro Ser Leu Tyr Ile Pro Pro His Lys Ile Thr Ile Gln Leu Ser Asn Leu Leu Lys Cys
Ile Lys Ile Lys Asn Ser Ile Val Ser Val Asn Ile Arg His Tyr Asn Asn Phe Lys Arg Val Tyr Val Leu
Met Gln Thr Phe Ala Ser Ser Phe Tyr Leu Lys Lys Gly Cys Val Cys Met Asn Tyr Leu Lys Lys Val
Trp Leu Tyr Tyr Ala Ile Val Ala Thr Leu Ile Ile Ser Phe Leu Thr Pro Phe Ser Thr Ala Gln Ala Asn
Thr Ala Pro Val Asn Gly Thr Met Met Gln Tyr Phe Glu Trp Asp Leu Pro Asn Asp Gly Thr Leu
Trp Thr Lys Val Lys Asn Glu Ala Ser Ser Leu Ser Ser Leu Gly Ile Thr Ala Leu Trp Leu Pro Pro
Ala Tyr Lys Gly Thr Ser Gln Gly Asp Val Gly Tyr Gly Val Tyr Asp Leu Tyr Asp Leu Gly Glu Phe
Asn Gln Lys Gly Thr Ile Arg Thr Lys Tyr Gly Thr Lys Thr Gln Tyr Leu Gln Ala Ile Gln Ala Ala
Lys Ser Ala Gly Met Gln Val Tyr Ala Asp Val Val Phe Asn His Lys Ala Gly Ala Asp Ser Thr Glu
Trp Val Asp Ala Val Glu Val Asn Pro Ser Asn Arg Asn Gln Glu Thr Ser Gly Thr Tyr Gln Ile Gln
Ala Trp Thr Lys Phe Asp Phe Pro Asp Arg Gly Asn Thr Tyr Ser Ser Phe Lys Trp Arg Trp Tyr His
Phe Asp Gly Thr Asp Trp Asp Glu Ser Arg Lys Leu Asn Arg Ile Tyr Lys Phe Arg Gly Thr Gly Lys
Ala Trp Asp Trp Glu Val Asp Thr Glu Asn Gly Asn Tyr Asp Tyr Leu Met Phe Ala Asp Leu Asp
Met Asp His Pro Glu Val Val Thr Glu Leu Lys Asn Trp Gly Thr Trp Tyr Val Asn Thr Thr Asn Val
Asp Gly Phe Arg Leu Asp Ala Val Lys His Ile Lys Tyr Ser Phe Phe Pro Asp Trp Leu Thr Tyr Val
Arg Ser Gln Thr Gln Lys Asn Leu Phe Ala Val Gly Glu Phe Trp Ser Tyr Asp Val Asn Lys Leu His
Asn Tyr Ile Thr Lys Thr Ser Gly Thr Met Ser Leu Phe Asp Ala Pro Leu His Asn Asn Phe Tyr Thr
Ala Ser Lys Ser Ser Gly Tyr Phe Asp Met Arg Tyr Leu Leu Asn Asn Thr Leu Met Lys Asp Gln
Pro Ser Leu Ala Val Thr Leu Val Asp Asn His Asp Thr Gln Pro Gly Gln Ser Leu Gln Ser Trp Val
Glu Pro Trp Phe Lys Pro Leu Ala Tyr Ala Phe Ile Leu Thr Arg Gln Glu Gly Tyr Pro Cys Val Phe
Tyr Gly Asp Tyr Tyr Gly Ile Pro Lys Tyr Asn Ile Pro Gly Leu Lys Ser Lys Ile Asp Pro Leu Leu Ile
Ala Arg Arg Asp Tyr Ala Tyr Gly Thr Gln Arg Asp Tyr Ile Asp His Gln Asp Ile Ile Gly Trp Thr
Arg Glu Gly Ile Asp Ser Lys Pro Asn Ser Gly Leu Ala Ala Leu Ile Thr Asp Gly Pro Gly Gly Ser
Lys Trp Met Tyr Val Gly Lys Lys His Ala Gly Lys Val Phe Tyr Asp Leu Thr Gly Asn Arg Ser Asp
Thr Val Thr Ile Asn Ala Asp Gly Trp Gly Glu Phe Lys Val Asn Gly Gly Ser Val Ser Ile Trp Val
Ala Lys Thr Ser Gln Val Thr Phe Thr Val Asn Asn Ala Thr Thr Thr Ser Gly Gln Asn Val Tyr Val
Val Gly Asn Ile Pro Glu Leu Gly Asn Trp Asn Thr Ala Asn Ala Ile Lys Met Thr Pro Ser Ser Tyr
Pro Thr Trp Lys Thr Thr Ile Ala Leu Pro Gln Gly Lys Ala Ile Gly Gly Val Arg His Gly Pro SEQ ID NO: 137
gtgggacgggcaggcttggcgcatcactcgaacacttccgccaaggggacatacgggtcacctctcgaactgcgtccggatcgccccgccgt
ggccggggcggtcgagcttgaagatgtccagcggggagccgccgccgaggatcaccccggcggcgtactcgcccagggcggggctcag
cttgaagccgtggccggagccgcctccaggagccagacgttggaggcccgcggatggcggtcgaggaggaggtggccgtcggggctgt
tctcgtactggcagacgcgggtctcgaccagcggcgcgtccttcagggccgggaaccggcgggccacctcggcccgggccgcttccagca

gggccggggtgatcgtccgctcgcccgccgtgggatcgatgggctcgccccgggtgtcgtccgccaccttgaagccgcggtgctcgttgcc
ggggatgccgtagtagatccgctcgccgagatcgacccagaccggacagccgccctcctggaagcgcgggtcgcccggcggcgtgccga
agaagaacacctcctggcgggtgttgcggaggaaccgctcaccgatcacgtccgggaacagcccggccagccagggaccgcaggcgaag
acgtagaggtcggccgcgagagtggagccgtccgaaaggtgaagccgctccaagggccccgggaccatggcggcctgccggtactcccc
gccctcgccctggaacagctccaccacggtccggcaggcgcgccggggcgaacaggggcgccggcttcctcctcgtaccagatcgtgcggac
gccgtcgaaatcgacctgggggaagcggctccgggcctcccctgagacagctcggcgaccggcagccccgcgtcctccagaaaaggaa
gggagtcgcggacgtagctgtcgtcctcgccgcacatccagaggaccccggtccttttgtacagccggtaaccggactggacttcggcgtccc
gccagagctcgaaggagcgggcgacccactccacgtacagacggtcgggtccgtaggcgccgcggatgatccgcgtctcgccaccggag
ctggagcgggagtgccccggaccccaggcgtccaggaggtcaccgggctccgcggcggaggagatgcagggcggtccagccgcg
aaggcgccggcgccgacgacggcgatatggggatgggagggcatggcgggcgtaaggttatcgcagcccgatccttcgctggcatccat
ctccgaccggagtatcctggaaaattcgaagaaggagatcgacatgcaatcgaacggaaacgtga SEQ ID NO: 138
Val Gly Arg Ala Gly Leu Ala His His Ser Asn Thr Ser Ala Lys Gly Thr Tyr Gly Ser Pro Leu Glu
Leu Arg Pro Asp Arg Pro Ala Val Ala Gly Ala Val Glu Leu Glu Asp Val Gln Arg Gly Ala Ala Ala
Glu Asp His Pro Gly Gly Val Leu Ala Gln Gly Gly Ala Gln Leu Glu Ala Val Ala Gly Ala Ala Ser
Gln Glu Pro Asp Val Gly Gly Pro Arg Met Ala Val Glu Glu Glu Val Ala Val Gly Ala Val Leu Val
Leu Ala Asp Ala Gly Leu Asp Gln Arg Arg Val Leu Gln Gly Arg Glu Pro Ala Gly His Leu Gly
Pro Gly Arg Phe Gln Gln Gly Arg Gly Asp Arg Pro Leu Ala Arg Arg Gly Ile Asp Gly Leu Ala Pro
Gly Val Val Arg His Leu Glu Ala Ala Val Leu Val Ala Gly Asp Ala Val Val Asp Pro Leu Ala Glu
Ile Asp Pro Asp Arg Thr Ala Ala Leu Leu Glu Ala Arg Val Ala Arg Arg Arg Ala Glu Glu Glu His
Leu Leu Ala Gly Val Ala Glu Glu Pro Leu Thr Asp His Val Arg Glu Gln Pro Gly Gln Pro Gly Thr
Ala Gly Glu Asp Val Glu Val Gly Arg Glu Ser Gly Ala Val Arg Lys Val Lys Pro Leu Gln Gly Pro
Arg Asp His Gly Gly Leu Pro Val Leu Pro Ala Leu Ala Leu Glu Gln Leu His His Gly Pro Ala Gly
Ala Pro Gly Glu Gln Gly Ala Gly Phe Leu Leu Val Pro Asp Arg Ala Asp Ala Val Glu Ile Asp Leu
Gly Glu Ala Ala Pro Gly Leu Pro Leu Arg Gln Leu Gly Asp Arg Gln Pro Arg Val Leu Gln Lys
Arg Lys Gly Val Ala Asp Val Ala Val Val Leu Ala Ala His Pro Glu Asp Pro Gly Pro Phe Val Gln
Pro Val Thr Gly Leu Asp Phe Gly Val Pro Pro Glu Leu Glu Gly Ala Gly Asp Pro Leu His Val Gln
Thr Val Gly Ser Val Gly Ala Ala Asp Asp Pro Arg Leu Ala Thr Gly Ala Gly Ala Gly Val Pro Arg
Thr Pro Gly Val Gln Glu Gly His Pro Gly Ser Ala Ala Glu Glu Met Gln Gly Gly Pro Ala Ala Glu
Gly Ala Gly Ala Asp Asp Gly Asp Met Gly Met Gly Gly His Gly Gly Arg Lys Val Ile Ala Ala Arg
Ser Phe Ala Gly Ile Pro Ser Pro Thr Gly Val Ser Trp Lys Ile Arg Arg Arg Arg Ser Thr Cys Asn
Arg Thr Glu Thr SEQ ID NO: 139
atgaaaacattcaaccttaaacccacacttttacctttaactttgctgctgagttcgccggtattggcggcacaaaatggaactatgatgcagtatttc
cattggtatgtgccaaatgacggcgcactctggacacaagttgaaaacaatgcgccagcactatccgacaacggttttacagcgctgtggttgc
caccagcatataaaggcgcaggtggtagcaacgacgttggttacggtgtttacgatatgtatgacttaggggagtttgatcaaaaaggatcggta
cgaactaagtacggcaccaaagaccaatatctaaatgccatcaaagcagcacacaaaaacaatatccaaatttatggtgacgtagtgttcaacca
tcgtggcggtgcagatggcaagtcgtgggtcgataccaagcgtgtggattggaataaccgcaatattgaacttggcgataaatggattgaagca
tgggttgaatttagcttcccaggacgtaacgataaatactcagacttccattggacgtggtatcactttgatggcgtcgattgggatgacgcaggta
aagagaaagcgatctttaaattcaaaggtgatggtaaagcatgggattgggaagtcagttctgaaaaaggcaactatgactacctcatgtacgca
gacttagacatggatcacccagaagtgaagcaagagctgaaagattgggtgaatggtacttaaacatgacgggtgttgatggcttccgaatgg
atgcagtgaaacacatcaaatatcagtacctacaagagtggatcgattacttgcgtaagaaaacgggcaaagagctctttaccgttggtgagtac
tggaactacgacgtgaacaatctgcacaactttatgactaagacttctggcagcatgtcattgtttgatgcgcctttacatatgaacttctataacgct
tcacgctctggtggcaactttgatatgcgccgaatcatggatggcaccttgatgaaagacaacccagtgaaagcagtaacactggttgagaacc
atgatacgcaaccactacaggccttagagtctccggtggattggtggttcaaaccacttgcgtacgcgttcatttttgcttcgtgaggaaggttatcc
gtcagtcttctacgcagattactacggtgcgcaatacagcgataaagggcacgatatcaacatggtgaaagtgccttacattgagcaattggtga
aagcgcgtaaagattatgcttatggtaaacaacattcttaccttgaccactgggatgtgattggttggacacgagaagggggatgcggaacatccg

Figure 16DDD aactctatggcggttatcatgagtgatggtcctggcggaacaaagtggatgtacacaggttcaccgagcacacgttatgtcgataaactaggtatt
cgtaccgaagaagtatggactaacgctagtggatgggccgaattcccagtgaacggcggatcggttctgtttgggttggcgttaaataa SEQ ID NO: 140
Met Lys Thr Phe Asn Leu Lys Pro Thr Leu Leu Pro Leu Thr Leu Leu Leu Ser Ser Pro Val Leu Ala
Ala Gln Asn Gly Thr Met Met Gln Tyr Phe His Trp Tyr Val Pro Asn Asp Gly Ala Leu Trp Thr Gln
Val Glu Asn Asn Ala Pro Ala Leu Ser Asp Asn Gly Phe Thr Ala Leu Trp Leu Pro Pro Ala Tyr Lys
Gly Ala Gly Gly Ser Asn Asp Val Gly Tyr Gly Val Tyr Asp Met Tyr Asp Leu Gly Glu Phe Asp
Gln Lys Gly Ser Val Arg Thr Lys Tyr Gly Thr Lys Asp Gln Tyr Leu Asn Ala Ile Lys Ala Ala His
Lys Asn Asn Ile Gln Ile Tyr Gly Asp Val Val Phe Asn His Arg Gly Gly Ala Asp Gly Lys Ser Trp
Val Asp Thr Lys Arg Val Asp Trp Asn Asn Arg Asn Ile Glu Leu Gly Asp Lys Trp Ile Glu Ala Trp
Val Glu Phe Ser Phe Pro Gly Arg Asn Asp Lys Tyr Ser Asp Phe His Trp Thr Trp Tyr His Phe Asp
Gly Val Asp Trp Asp Asp Ala Gly Lys Glu Lys Ala Ile Phe Lys Phe Lys Gly Asp Gly Lys Ala Trp
Asp Trp Glu Val Ser Ser Glu Lys Gly Asn Tyr Asp Tyr Leu Met Tyr Ala Asp Leu Asp Met Asp
His Pro Glu Val Lys Gln Glu Leu Lys Asp Trp Gly Glu Trp Tyr Leu Asn Met Thr Gly Val Asp Gly
Phe Arg Met Asp Ala Val Lys His Ile Lys Tyr Gln Tyr Leu Gln Glu Trp Ile Asp Tyr Leu Arg Lys
Lys Thr Gly Lys Glu Leu Phe Thr Val Gly Glu Tyr Trp Asn Tyr Asp Val Asn Asn Leu His Asn
Phe Met Thr Lys Thr Ser Gly Ser Met Ser Leu Phe Asp Ala Pro Leu His Met Asn Phe Tyr Asn Ala
Ser Arg Ser Gly Gly Asn Phe Asp Met Arg Arg Ile Met Asp Gly Thr Leu Met Lys Asp Asn Pro
Val Lys Ala Val Thr Leu Val Glu Asn His Asp Thr Gln Pro Leu Gln Ala Leu Glu Ser Pro Val Asp
Trp Trp Phe Lys Pro Leu Ala Tyr Ala Phe Ile Leu Leu Arg Glu Glu Gly Tyr Pro Ser Val Phe Tyr
Ala Asp Tyr Tyr Gly Ala Gln Tyr Ser Asp Lys Gly His Asp Ile Asn Met Val Lys Val Pro Tyr Ile
Glu Gln Leu Val Lys Ala Arg Lys Asp Tyr Ala Tyr Gly Lys Gln His Ser Tyr Leu Asp His Trp Asp
Val Ile Gly Trp Thr Arg Glu Gly Asp Ala Glu His Pro Asn Ser Met Ala Val Ile Met Ser Asp Gly
Pro Gly Gly Thr Lys Trp Met Tyr Thr Gly Ser Pro Ser Thr Arg Tyr Val Asp Lys Leu Gly Ile Arg
Thr Glu Glu Val Trp Thr Asn Ala Ser Gly Trp Ala Glu Phe Pro Val Asn Gly Gly Ser Val Ser Val
Trp Val Gly Val Lys SEQ ID NO: 141
atgaaaccaataaatacccctactcatatccgcccttgctgtttgttctttcagttccgcgacttacgccgatactattttgcacgcgttcaattggaagt
attcagatgtgacggccaacgcgaatcaaattgctcaagctggttataagaaagtgcttgttgcgcctgcaatgaaatcgagtggcagccaatgg
tgggctcgctatcaacctcaagatctacgcactatcgattctcctttgggcaataaacaagatttagccgcaatgattgccgcactcaaaggtgtg
ggcgtcgatgtgtatgccgatgtggtactcaaccatatggcgaatgaaagctggaagcgaagtgacttgaattaccctggcacagaagtgctaa
acgattatgctagccgttcaagctactatgctgaccagactctgtttggcaacctagcacaaggttatgtgtcagcgaacgacttcatccagcgg
gctgtatttcagattggaacgaccctggtcatgttcagtattggcgtttgtgtggcgcagatggtgatgtaggtttacctgaccttgatccaaacaac
tgggtggttcacaacagcgtttgtatctgaaagcgctaaaagatatgggcatcaaagggttccgaattgatgcagtgaagcacatgagccaata
ccaaatcgatcaggtattcacgtctgaaattactgcgaacatgcatgtgtttggtgaagtgattactagcggtggagcagggaatagcggctatg
aatcgttcttagcgccttacctgaataatactaatcactctgcctacgatttcccgctgtttgcatcgattcgctcggcatttctatgggggcggttt
aaatcaactgcatgatcctaaagcgtacggtcaggcacttgatgataatcgctcgatcacctttgcgatcacacatgatattccaaccaatgacgg
cttccgctaccaaattatggacccacaagacgagcagcttgcttacgcgtatatccttggtaaagacggtggcacgccgctgatctacagtgatg
atcttcctgattctgaagacaaggataacggtcgttggggcaatgtttggaacagttcgacaatgaaaaacatgttgagcttccataacgcgatgc
aaggcaaaacaatgacgatgatttctagcgaccattgcactttgttgtttaagcgtggcaaagaaggtgttgtgggtattaacaagtgtggtgaaa
cgcgtggcgtgacggttgatacctaccaacatgagtttaattggcatgttcaatacaaagacgtgttaagcagcgcaacagaaaccgtgacttct
cgttaccatacgttcaatctaccaccacgcagtgcgcgtatgtttaagctgtag SEQ ID NO: 142
Met Lys Pro Ile Asn Thr Leu Leu Ile Ser Ala Leu Ala Val Cys Ser Phe Ser Ser Ala Thr Tyr Ala
Asp Thr Ile Leu His Ala Phe Asn Trp Lys Tyr Ser Asp Val Thr Ala Asn Ala Asn Gln Ile Ala Gln
Ala Gly Tyr Lys Lys Val Leu Val Ala Pro Ala Met Lys Ser Ser Gly Ser Gln Trp Trp Ala Arg Tyr
Gln Pro Gln Asp Leu Arg Thr Ile Asp Ser Pro Leu Gly Asn Lys Gln Asp Leu Ala Ala Met Ile Ala

Figure 16EEE

Ala Leu Lys Gly Val Gly Val Asp Val Tyr Ala Asp Val Val Leu Asn His Met Ala Asn Glu Ser Trp
Lys Arg Ser Asp Leu Asn Tyr Pro Gly Thr Glu Val Leu Asn Asp Tyr Ala Ser Arg Ser Ser Tyr Tyr
Ala Asp Gln Thr Leu Phe Gly Asn Leu Ala Gln Gly Tyr Val Ser Ala Asn Asp Phe His Pro Ala Gly
Cys Ile Ser Asp Trp Asn Asp Pro Gly His Val Gln Tyr Trp Arg Leu Cys Gly Ala Asp Gly Asp Val
Gly Leu Pro Asp Leu Asp Pro Asn Asn Trp Val Val Ser Gln Gln Arg Leu Tyr Leu Lys Ala Leu
Lys Asp Met Gly Ile Lys Gly Phe Arg Ile Asp Ala Val Lys His Met Ser Gln Tyr Gln Ile Asp Gln
Val Phe Thr Ser Glu Ile Thr Ala Asn Met His Val Phe Gly Glu Val Ile Thr Ser Gly Gly Ala Gly
Asn Ser Gly Tyr Glu Ser Phe Leu Ala Pro Tyr Leu Asn Asn Thr Asn His Ser Ala Tyr Asp Phe Pro
Leu Phe Ala Ser Ile Arg Ser Ala Phe Ser Met Gly Gly Gly Leu Asn Gln Leu His Asp Pro Lys Ala
Tyr Gly Gln Ala Leu Asp Asp Asn Arg Ser Ile Thr Phe Ala Ile Thr His Asp Ile Pro Thr Asn Asp
Gly Phe Arg Tyr Gln Ile Met Asp Pro Gln Asp Glu Gln Leu Ala Tyr Ala Tyr Ile Leu Gly Lys Asp
Gly Gly Thr Pro Leu Ile Tyr Ser Asp Asp Leu Pro Asp Ser Glu Asp Lys Asp Asn Gly Arg Trp Gly
Asn Val Trp Asn Ser Ser Thr Met Lys Asn Met Leu Ser Phe His Asn Ala Met Gln Gly Lys Thr
Met Thr Met Ile Ser Ser Asp His Cys Thr Leu Leu Phe Lys Arg Gly Lys Glu Gly Val Val Gly Ile
Asn Lys Cys Gly Glu Thr Arg Gly Val Thr Val Asp Thr Tyr Gln His Glu Phe Asn Trp His Val Gln
Tyr Lys Asp Val Leu Ser Ser Ala Thr Glu Thr Val Thr Ser Arg Tyr His Thr Phe Asn Leu Pro Pro
Arg Ser Ala Arg Met Phe Lys Leu

SEQ ID NO: 143
atgccaaagagcacttttaccaaatccataacaaaatcacttcttgctacttccgttgttgtaagcttattgcctgcctacgcacaggccgacactat
cttgcatgcctttaactggaaatacagcgacattacccgccaagcagagcaaattgcgcaagctggttataaaaaagtactgatttcaccgccgc
tgaagtccacaggcccacaatggtgggcacgttaccaaccacaggacattcgagtgattgactcccctgtcggcaacaagcaagatttacaag
ccctcattgcagccttaaaggcacaaggcgttgaagtatacgcagacatcgtactcaaccacatggccaacgaaagctggaaacgagacgatc
tgaactaccgggaagtgatttacttaccaatacagccaaaatatggcttacatgaaccagcaaaaattgtttggagatttagagcaaaatcagtt
ctctgccaatgattttcacccggctggctgcattactgattggagtaacccggggcatgttcaatactggcgcttatgtggtggtaatggtgacact
gggttacctgatcttgatcctaactcgtgggtgatcgatcaacaaaaacgttatttacgtgctttgaaagacatgggaataaagggcttccgagttg
atgcggtaaaacacatgagcgattaccaaatcaaccaagtgtttacgccagacatcatcgcaggcttacatgtatttggtgaagtgatcaccagtg
gtggcaagggcagcaatgactaccactcttttctggaaccgtatttaaataacaccaatcacgccgcgtatgacttcccgctatttgcctctatccg
aaatgcatttagttatcatggcagcttgtctcaattacatgatccacaagcttacgggcaagcacttcctaacgacagagccattactttcaccatca
ctcacgacattccaaccaatgatgglttccgttaccaaatcatggatccaaccagtgaaaaactcgcgtacgcgtacattctaggcaaagatggg
gglagcccacttatctatagcgatgctttagacccaagtgaagataaagataagggccgctggcgtgatgtatggaaccaagaatacatggttaa
catgatcagcttccacaacaaggtgcaaggtaaaagcatggaggtcatgtacagcgatcaatgcttgctggtctttaaacgtgaaaaacaaggct
tagtcggtattaataagtgcgctgaaagccgtacctacaccatagatacccatcgtttgaatttaactggtaccaaccgtacaacgacacacattaag
ccagcacagcgagacctttagcagccgttatcatgctctgaccattccggcgcaaacagcacgaatgttggcgctataa SEQ ID NO: 144
Met Pro Lys Ser Thr Phe Thr Lys Ser Ile Thr Lys Ser Leu Leu Ala Thr Ser Val Val Val Ser Leu
Leu Pro Ala Tyr Ala Gln Ala Asp Thr Ile Leu His Ala Phe Asn Trp Lys Tyr Ser Asp Ile Thr Arg
Gln Ala Glu Gln Ile Ala Gln Ala Gly Tyr Lys Lys Val Leu Ile Ser Pro Pro Leu Lys Ser Thr Gly Pro
Gln Trp Trp Ala Arg Tyr Gln Pro Gln Asp Ile Arg Val Ile Asp Ser Pro Val Gly Asn Lys Gln Asp
Leu Gln Ala Leu Ile Ala Ala Leu Lys Ala Gln Gly Val Glu Val Tyr Ala Asp Ile Val Leu Asn His
Met Ala Asn Glu Ser Trp Lys Arg Asp Asp Leu Asn Tyr Pro Gly Ser Asp Leu Leu Thr Gln Tyr Ser
Gln Asn Met Ala Tyr Met Asn Gln Gln Lys Leu Phe Gly Asp Leu Glu Gln Asn Gln Phe Ser Ala
Asn Asp Phe His Pro Ala Gly Cys Ile Thr Asp Trp Ser Asn Pro Gly His Val Gln Tyr Trp Arg Leu
Cys Gly Gly Asn Gly Asp Thr Gly Leu Pro Asp Leu Asp Pro Asn Ser Trp Val Ile Asp Gln Gln Lys
Arg Tyr Leu Arg Ala Leu Lys Asp Met Gly Ile Lys Gly Phe Arg Val Asp Ala Val Lys His Met Ser
Asp Tyr Gln Ile Asn Gln Val Phe Thr Pro Asp Ile Ile Ala Gly Leu His Val Phe Gly Glu Val Ile Thr
Ser Gly Gly Lys Gly Ser Asn Asp Tyr His Ser Phe Leu Glu Pro Tyr Leu Asn Asn Thr Asn His Ala
Ala Tyr Asp Phe Pro Leu Phe Ala Ser Ile Arg Asn Ala Phe Ser Tyr His Gly Ser Leu Ser Gln Leu
His Asp Pro Gln Ala Tyr Gly Gln Ala Leu Pro Asn Asp Arg Ala Ile Thr Phe Thr Ile Thr His Asp

Figure 16FFF

Ile Pro Thr Asn Asp Gly Phe Arg Tyr Gln Ile Met Asp Pro Thr Ser Glu Lys Leu Ala Tyr Ala Tyr
Ile Leu Gly Lys Asp Gly Gly Ser Pro Leu Ile Tyr Ser Asp Ala Leu Asp Pro Ser Glu Asp Lys Asp
Lys Gly Arg Trp Arg Asp Val Trp Asn Gln Glu Tyr Met Val Asn Met Ile Ser Phe His Asn Lys Val
Gln Gly Lys Ser Met Glu Val Met Tyr Ser Asp Gln Cys Leu Leu Val Phe Lys Arg Glu Lys Gln
Gly Leu Val Gly Ile Asn Lys Cys Ala Glu Ser Arg Thr Tyr Thr Ile Asp Thr His Arg Phe Glu Phe
Asn Trp Tyr Gln Pro Tyr Asn Asp Thr Leu Ser Gln His Ser Glu Thr Phe Ser Ser Arg Tyr His Ala
Leu Thr Ile Pro Ala Gln Thr Ala Arg Met Leu Ala Leu

SEQ ID NO: 145
atgttgaaaaggattacggtagtctgtttattatttattttgcttttccctaatatatatgggaggaataaggcggaagcagcaacgataaataatgga
acattaatgcagtattttgagtggtacgctccgaatgatgggaatcattggaatcgtttgcgttatgatgctgaaagtttagctcataagggaatcac
atctgtatggataccacctgcatataaagggacttcgcaaaatgatgtagggtatggggcctatgatttatacgatttaggggagttcaatcaaaaa
ggaacggtgcggacgaaatatgggacaaaggcacagttgaaatctgcaattgacgctttacataagcaaaacatcgacgtatacggtgatgta
gttatgaatcataaaggtggggctgattatactgaaaccgtaacagctgttgaggtagaccgtaacaatcgaaatattgaagtatcaggtgattatg
aaattagtgcgtggacgggttttaactttccagggcgcagagatgcttattctaatttcaaatggaaatggtatcattttgacggaacggattgggat
gaaggaaggaaattaaaccgaatttataaatttaggggtataggtaaagcgtgggactgggaagtgtctagcgaaaatggaaattatgattatttg
atgtatgcagatcttgattttgatcatccagatgttgcgaatgaaatgaaaagttggggaacgtggtatgcgaatgaattaaatttagatggatttcgt
ttagatgctgttaaacatattgatcatgaatatttacgcgattgggtaaatcatgtcagacagcaaacggggaaagaaatgtttacggtggctgaat
attggcaaaatgatatccagactttaaacaattatttggcgaaagtcaattataatcaatctgtatttgatgcaccgcttcattacaattttcattatgctt
caacaggaaatgggaattatgatatgagaaatattttaaatggaacagtaatgaaaaatcatcctgcactcgcagttactctcgttgagaatcatga
ttctcaacctgggcaatcattggaatctgtagtaagtccgtggtttaagccgctggcatatgcatttattttaactcgtgcagagggctatccttcagt
tttttatggtgattactatgggacaagcggaaatagtagttatgaaattccagcgttaaaagataaaattgatccaattttgacggcacgaaaaaact
ttgcatatggtacgcagcgtgattatttagaccatccagatgtgattggctggacaagagaaggagatagtgtacatgctaagtctggtttagcgg
cattaatctccgatggaccaggaggatcaaagtggatggatgttggaaagaataacgctggggaagtatggtacgatattacgggtaatcaaac
aaatactgtaacaattaataaagatggatcggggcaattccatgtaagtggaggctctgtttctatatatgttcaacagtaa SEQ ID NO: 146
Met Leu Lys Arg Ile Thr Val Val Cys Leu Leu Phe Ile Leu Leu Phe Pro Asn Ile Tyr Gly Arg Asn
Lys Ala Glu Ala Ala Thr Ile Asn Asn Gly Thr Leu Met Gln Tyr Phe Glu Trp Tyr Ala Pro Asn Asp
Gly Asn His Trp Asn Arg Leu Arg Tyr Asp Ala Glu Ser Leu Ala His Lys Gly Ile Thr Ser Val Trp
Ile Pro Pro Ala Tyr Lys Gly Thr Ser Gln Asn Asp Val Gly Tyr Gly Ala Tyr Asp Leu Tyr Asp Leu
Gly Glu Phe Asn Gln Lys Gly Thr Val Arg Thr Lys Tyr Gly Thr Lys Ala Gln Leu Lys Ser Ala Ile
Asp Ala Leu His Lys Gln Asn Ile Asp Val Tyr Gly Asp Val Val Met Asn His Lys Gly Gly Ala Asp
Tyr Thr Glu Thr Val Thr Ala Val Glu Val Asp Arg Asn Asn Arg Asn Ile Glu Val Ser Gly Asp Tyr
Glu Ile Ser Ala Trp Thr Gly Phe Asn Phe Pro Gly Arg Arg Asp Ala Tyr Ser Asn Phe Lys Trp Lys
Trp Tyr His Phe Asp Gly Thr Asp Trp Asp Glu Gly Arg Lys Leu Asn Arg Ile Tyr Lys Phe Arg Gly
Ile Gly Lys Ala Trp Asp Trp Glu Val Ser Ser Glu Asn Gly Asn Tyr Asp Tyr Leu Met Tyr Ala Asp
Leu Asp Phe Asp His Pro Asp Val Ala Asn Glu Met Lys Ser Trp Gly Thr Trp Tyr Ala Asn Glu Leu
Asn Leu Asp Gly Phe Arg Leu Asp Ala Val Lys His Ile Asp His Glu Tyr Leu Arg Asp Trp Val Asn
His Val Arg Gln Gln Thr Gly Lys Glu Met Phe Thr Val Ala Glu Tyr Trp Gln Asn Asp Ile Gln Thr
Leu Asn Asn Tyr Leu Ala Lys Val Asn Tyr Asn Gln Ser Val Phe Asp Ala Pro Leu His Tyr Asn
Phe His Tyr Ala Ser Thr Gly Asn Gly Asn Tyr Asp Met Arg Asn Ile Leu Asn Gly Thr Val Met Lys
Asn His Pro Ala Leu Ala Val Thr Leu Val Glu Asn His Asp Ser Gln Pro Gly Gln Ser Leu Glu Ser
Val Val Ser Pro Trp Phe Lys Pro Leu Ala Tyr Ala Phe Ile Leu Thr Arg Ala Glu Gly Tyr Pro Ser
Val Phe Tyr Gly Asp Tyr Tyr Gly Thr Ser Gly Asn Ser Ser Tyr Glu Ile Pro Ala Leu Lys Asp Lys
Ile Asp Pro Ile Leu Thr Ala Arg Lys Asn Phe Ala Tyr Gly Thr Gln Arg Asp Tyr Leu Asp His Pro
Asp Val Ile Gly Trp Thr Arg Glu Gly Asp Ser Val His Ala Lys Ser Gly Leu Ala Ala Leu Ile Ser
Asp Gly Pro Gly Gly Ser Lys Trp Met Asp Val Gly Lys Asn Asn Ala Gly Glu Val Trp Tyr Asp Ile
Thr Gly Asn Gln Thr Asn Thr Val Thr Ile Asn Lys Asp Gly Ser Gly Gln Phe His Val Ser Gly Gly
Ser Val Ser Ile Tyr Val Gln Gln

Figure 16GGG

SEQ ID NO: 147
atgagcttaaataactttaaggtaaaactgcttagttttgctgtgtcttctgctgtattgtcactggctccaaatttagccaatgctgcaaattttgaaag
tgagatggtgataatccatccgtttcagtggacatatgacaatatagcaaaagagtgtacagagtaccttggtccagccggatttgacggtgtaca
gatttcccagccagcggaacataagcgggctgaaggagtatggtgggccgtatatcagccggttaattataagaatttacaaccatgaccggta
acgaggagcagcttaaggcaatgatcaagacctgtaatgatgcaggtgttaaggtgttcgctgacgctgttttcaaccaaaaggctacagacgg
tgtaggctggggcggttcaacttggagttataagaactaccctgacggattctccggatcagatttccatggagactgttccattgacaaaagctat
actgatgcaaataatgtcagaacctgtgcactctcaggtatgccggacgttgccacagataactccgctactcaggaaaagattgcagattacct
cgcttctttaatgaatatgggggtctatggtttccgtattgacgctgcaaagcacatgggatacaacgatatcaactccattctttcaaaaactgcac
agaagactggaagaagacctcctgcatatctggaagtaatcggagccggtaacgaagctgccgacattcagccggacaagtataccttattga
gaatgcggttgtaactgacttcggttatgtctgggatgcaaatgagagtttcggaaagggtaattacggtaaggcactggaactcagtacctggct
cggtgcaaattcagaaacattcgtaaacaatcatgatgatgaatgggcagatgctcagccggtagctgctcaatgaaaactcagaattatgctg
attataatctggctcagtcctggcttgctgtatggcctgtaggtacagtaagacagatatattccggttattcattccctgaaaagataatgatccta
tcgcgtcagtgatgcaactcatgatcagggcgggcctcttggtgccgaccgctgtgaaggtggctggttgtgtcagcaccgtgtgtccttcgttct
caattccccaagatttgcgagagctaccagaggtactgctgtatcaaccaaggaatttgacaatggtgctttgtggtttaacagaggaagcaaag
gttttatgcacagaatactaccaacagtcctataacccagacattctctgttgaagtacctgacggaaattactgtgatatcttaggaacatcagat
cctaagagcaatccatgcggagcagacgttgtcgtaagcggcggtaaggctaccttactattcctgcaaagacagctgtggctatctgtacaga
ctcagactggtgcggcaagggggttgatccttgtgaaagtgatccgaccggtgctgcctgtgtttgtaaggggggaaaccaccgttaatggtgtgt
gcgtcagctggtgtaatgcgcattcatcaaatgaggaatgcacctgtgtattgaatccgaatgatgccaactgtcaggctgatattgaacctacca
agggtaaactctgttacgccggtacttcaaacgggtggaaacaggatccttaacatataaccgtaaaacaggtttctggactattaatctgactctt
gacggtgcaggtgataccagcggagctcagcgcttcaaggttacagacggatgttcatggaccggaacagtttacggttcttcaggtactgccg
gaaagttggatgtaaatacatcatcaaccggcgatgaacctgtgtctcttgttggtgattatgttcttccattaacgataagaccatggaatatacat
tcaccaaggcagatgaagtaactaatcagccaccggttgcatcatttaccgcgacagttaacggtctgaccgtttcttttgccaataattcatccga
ccctgagaatgatgaattaacctacagctggaatttcggtaatggtaaaacatcatccgagaaagctcctagcataacctatgaagaatccggta
agtatactgttactttaaaggttactgattcagctaataacactgatacatttactaaagatataactgtaacagcaccttctagtggcaagtacttaaa
ggttgcagtcagaggttcgcatgataattacggaactgatctgttaaccaagaacggttctgattggaccggcgtctttgaattctttggatccacta
gtgtcgacctgcaggcgcgcagctc SEQ ID NO: 148
Met Ser Leu Asn Asn Phe Lys Val Lys Leu Leu Ser Phe Ala Val Ser Ser Ala Val Leu Ser Leu Ala
Pro Asn Leu Ala Asn Ala Ala Asn Phe Glu Ser Glu Met Val Ile Ile His Pro Phe Gln Trp Thr Tyr
Asp Asn Ile Ala Lys Glu Cys Thr Glu Tyr Leu Gly Pro Ala Gly Phe Asp Gly Val Gln Ile Ser Gln
Pro Ala Glu His Lys Arg Ala Glu Gly Val Trp Trp Ala Val Tyr Gln Pro Val Asn Tyr Lys Asn Phe
Thr Thr Met Thr Gly Asn Glu Glu Gln Leu Lys Ala Met Ile Lys Thr Cys Asn Asp Ala Gly Val Lys
Val Phe Ala Asp Ala Val Phe Asn Gln Lys Ala Thr Asp Gly Val Gly Trp Gly Gly Ser Thr Trp Ser
Tyr Lys Asn Tyr Pro Asp Gly Phe Ser Gly Ser Asp Phe His Gly Asp Cys Ser Ile Asp Lys Ser Tyr
Thr Asp Ala Asn Asn Val Arg Thr Cys Ala Leu Ser Gly Met Pro Asp Val Ala Thr Asp Asn Ser Ala
Thr Gln Glu Lys Ile Ala Asp Tyr Leu Ala Ser Leu Met Asn Met Gly Val Tyr Gly Phe Arg Ile Asp
Ala Ala Lys His Met Gly Tyr Asn Asp Ile Asn Ser Ile Leu Ser Lys Thr Ala Gln Lys Thr Gly Arg
Arg Pro Pro Ala Tyr Leu Glu Val Ile Gly Ala Gly Asn Glu Ala Ala Asp Ile Gln Pro Asp Lys Tyr
Thr Phe Ile Glu Asn Ala Val Val Thr Asp Phe Gly Tyr Val Trp Asp Ala Asn Glu Ser Phe Gly Lys
Gly Asn Tyr Gly Lys Ala Leu Glu Leu Ser Thr Trp Leu Gly Ala Asn Ser Glu Thr Phe Val Asn Asn
His Asp Asp Glu Trp Gly Arg Cys Ser Ala Gly Ser Cys Ser Met Lys Thr Gln Asn Tyr Ala Asp Tyr
Asn Leu Ala Gln Ser Trp Leu Ala Val Trp Pro Val Gly Thr Val Arg Gln Ile Tyr Ser Gly Tyr Ser
Phe Pro Val Lys Asp Asn Asp Pro Tyr Arg Val Ser Asp Ala Thr His Asp Gln Gly Gly Pro Leu Gly
Ala Asp Arg Cys Glu Gly Gly Trp Leu Cys Gln His Arg Val Ser Phe Val Leu Asn Ser Pro Arg Phe
Ala Arg Ala Thr Arg Gly Thr Ala Val Ser Thr Lys Gly Phe Asp Asn Gly Ala Leu Trp Phe Asn Arg
Gly Ser Lys Gly Phe Tyr Ala Gln Asn Thr Thr Asn Ser Pro Ile Thr Gln Thr Phe Ser Val Glu Val
Pro Asp Gly Asn Tyr Cys Asp Ile Leu Gly Thr Ser Asp Pro Lys Ser Asn Pro Cys Gly Ala Asp Val
Val Val Ser Gly Gly Lys Ala Thr Phe Thr Ile Pro Ala Lys Thr Ala Val Ala Ile Cys Thr Asp Ser

Figure 16HHH

Asp Trp Cys Gly Lys Gly Val Asp Pro Cys Glu Ser Asp Pro Thr Gly Ala Ala Cys Val Cys Lys Gly
Glu Thr Thr Val Asn Gly Val Cys Val Ser Trp Cys Asn Ala His Ser Ser Asn Glu Glu Cys Thr Cys
Val Leu Asn Pro Asn Asp Ala Asn Cys Gln Ala Asp Ile Glu Pro Thr Lys Gly Lys Leu Cys Tyr Ala
Gly Thr Ser Asn Gly Trp Lys Gln Asp Pro Leu Thr Tyr Asn Arg Lys Thr Gly Phe Trp Thr Ile Asn
Leu Thr Leu Asp Gly Ala Gly Asp Thr Ser Gly Ala Gln Arg Phe Lys Val Thr Asp Gly Cys Ser Trp
Thr Gly Thr Val Tyr Gly Ser Ser Gly Thr Ala Gly Lys Leu Asp Val Asn Thr Ser Ser Thr Gly Asp
Glu Pro Val Ser Leu Val Gly Asp Tyr Val Leu Ser Ile Asn Asp Lys Thr Met Glu Tyr Thr Phe Thr
Lys Ala Asp Glu Val Thr Asn Gln Pro Pro Val Ala Ser Phe Thr Ala Thr Val Asn Gly Leu Thr Val
Ser Phe Ala Asn Asn Ser Ser Asp Pro Glu Asn Asp Glu Leu Thr Tyr Ser Trp Asn Phe Gly Asn Gly
Lys Thr Ser Ser Glu Lys Ala Pro Ser Ile Thr Tyr Glu Glu Ser Gly Lys Tyr Thr Val Thr Leu Lys
Val Thr Asp Ser Ala Asn Asn Thr Asp Thr Phe Thr Lys Asp Ile Thr Val Thr Ala Pro Ser Ser Gly
Lys Tyr Leu Lys Val Ala Val Arg Gly Ser His Asp Asn Tyr Gly Thr Asp Leu Leu Thr Lys Asn Gly
Ser Asp Trp Thr Gly Val Phe Glu Phe Phe Gly Ser Thr Ser Val Asp Leu Gln Ala Arg Glu Leu

SEQ ID NO: 149
atgatcttaagtaattttaaggtaaaacttcttagttttgctgtgtcttctgctgtactgacactggctgcaaatgtcgccaatgccaagaattatgaaa
gtgaaatggttattattcatccatttcagtggacatatgacaatatagcaaaagaatgtactgagtatctgggacctgcgggatttgacggggtgca
gatttcccaggcggctgagcataaagatgccggtggtgcatggtggggtacctaccagcctgtaaacttcaagagttttactaccatggttggta
atgaagaacagcttagagcaatgattaaaacctgtaacgaggcaggtgttaaggtctttgccgatgccgtgattaatcagaaagccggcgacgg
tgtaggtataggtggttcaacttttcggaaattataattatcctgacggatttaccagtgatgattttcatcataatactgcagtataggtaataattatt
cagatgcatgggtagtaagattctgtgacctcagtggcatgccggatatagcaactgataacgacagtaccagaaataagattgctgattacttcg
ccagccttatgaatatgggggtatacggattccgtattgatgctgccaagcactttagctatgatgatatagacgctattgtagagaaaacagcaa
ccaaagcaggcaggagacctcctgtctatatggaggttatcggtaatccgggtcaagaggcggatgatatccagccgaacaagtatacatgga
ttgataatgccgttgtaacagatttacttatgctaatagcatgcataatattttaacggaagcggttatgccaaggctttgaacatgggctagggc
atgttgatgctgaaaatgccgaagtctttataagtaatcatgataatgaatggggaagaaagtctgccggttcctgctcaataagaacccagaata
atccggattaccatctggctcagtcctggctcgcagtttggcctttaggcaaggttagacagatttattctgcatatcagttccggtctttgaagata
gttgtgagcgggtcagtcagcaagcccatgatcagggcggtcctatcggggcagcccgctgtgaaggtggctggttgtgtcagcaccgtgtac
cgtttgtgctcaattctcctagatttgcaagagcaaccagagggacagtcgttactactaaaggttttgatgacggagcttgtggtttaacagagg
aagcaagggcttctatgccagaatactaccggcagttctataactcatacattctcagttgaattacctgatggaaattactgtgatatccttggag
caaccgatccgaagaataatccttgcggagcggatgtcactgtaagcggaggtaaagcaaccttaccattccggcaaagaccgccgtagcta
tctgtactgatgaaaagtggtgtggcaaggggttgaccttgtgaaagcgatcctaccggttccgcctgtgtatgtaagggtgaaaccacagtt
aacggcgtatgtgtaagctggtgtaatgctcactcatctaatgaagaatgtgcctgtgtgctaaatcctaatgacgctgagtgtcaggccgacatt
gagccgaccaagggtaaactctgctatgtaggtacctccaacaagtggactcaggaaccttaacctataatcgcaagaccggtttctggactct
caacgttgaacttgacggtaaggggggataccagcggggcgcagcgctttaaagttaccgacggctgttcatggcagggtactgtttacggtca
tcaggagtagaaggcagacttgacgtaaatacttcagccaccggagatgaaccggtttcactgacaggtaaatatgttcttccataaatgataag
accatggaatacacattcattcctgcaggcagtggaaacaagcctccggttgcgtcatttactccgactgttaaagatctgactgtatcttttgtcaa
taattcatccgaccctgagaatgatgaattaacctacagctggaatttcggtaacggtaaaacctcatctgaaaagaatccgagtgttacatatgat
aaagccggtaaatatactgtttcactcaaagtaaccgatactgcaaacaacactgataccaaaacactggaaatcgatttaacatctcctgttaacg
gaaaatattccaaggttgcagtcagaggttcacatgataactacggaacaaatctgttaaccaggaatggttcagaatggaccggtatctttgaatt
cagtaagacaaccaaattcaagcttgaagctctgcctcctgcagctgaccagtgtatcttcctcggcggtaatcgaggtgaggcattgactgcct
ccggtggatttatatctcttcctgccggaaggtatactataaagtttaatgaggaaagcaaggttcttactgcaggcgatgttgactgcaccggg SEQ ID NO: 150
Met Ile Leu Ser Asn Phe Lys Val Lys Leu Leu Ser Phe Ala Val Ser Ser Ala Val Leu Thr Leu Ala
Ala Asn Val Ala Asn Ala Lys Asn Tyr Glu Ser Glu Met Val Ile Ile His Pro Phe Gln Trp Thr Tyr
Asp Asn Ile Ala Lys Glu Cys Thr Glu Tyr Leu Gly Pro Ala Gly Phe Asp Gly Val Gln Ile Ser Gln
Ala Ala Glu His Lys Asp Ala Gly Gly Ala Trp Trp Gly Thr Tyr Gln Pro Val Asn Phe Lys Ser Phe
Thr Thr Met Val Gly Asn Glu Glu Gln Leu Arg Ala Met Ile Lys Thr Cys Asn Glu Ala Gly Val Lys
Val Phe Ala Asp Ala Val Ile Asn Gln Lys Ala Gly Asp Gly Val Gly Ile Gly Gly Ser Thr Phe Gly
Asn Tyr Asn Tyr Pro Asp Gly Phe Thr Ser Asp Asp Phe His His Asn Asn Cys Ser Ile Gly Asn Asn

Figure 16III

Tyr Ser Asp Ala Trp Val Val Arg Phe Cys Asp Leu Ser Gly Met Pro Asp Ile Ala Thr Asp Asn Asp
Ser Thr Arg Asn Lys Ile Ala Asp Tyr Phe Ala Ser Leu Met Asn Met Gly Val Tyr Gly Phe Arg Ile
Asp Ala Ala Lys His Phe Ser Tyr Asp Asp Ile Asp Ala Ile Val Glu Lys Thr Ala Thr Lys Ala Gly
Arg Arg Pro Pro Val Tyr Met Glu Val Ile Gly Asn Pro Gly Gln Glu Ala Asp Asp Ile Gln Pro Asn
Lys Tyr Thr Trp Ile Asp Asn Ala Val Val Thr Asp Phe Thr Tyr Ala Asn Ser Met His Asn Ile Phe
Asn Gly Ser Gly Tyr Ala Lys Ala Leu Asn Met Gly Leu Gly His Val Asp Ala Glu Asn Ala Glu Val
Phe Ile Ser Asn His Asp Asn Glu Trp Gly Arg Lys Ser Ala Gly Ser Cys Ser Ile Arg Thr Gln Asn
Asn Pro Asp Tyr His Leu Ala Gln Ser Trp Leu Ala Val Trp Pro Leu Gly Lys Val Arg Gln Ile Tyr
Ser Ala Tyr Gln Phe Pro Val Phe Glu Asp Ser Cys Glu Arg Val Ser Gln Gln Ala His Asp Gln Gly
Gly Pro Ile Gly Ala Ala Arg Cys Glu Gly Gly Trp Leu Cys Gln His Arg Val Pro Phe Val Leu Asn
Ser Pro Arg Phe Ala Arg Ala Thr Arg Gly Thr Val Val Thr Thr Lys Gly Phe Asp Asp Gly Ala Leu
Trp Phe Asn Arg Gly Ser Lys Gly Phe Tyr Ala Gln Asn Thr Thr Gly Ser Ser Ile Thr His Thr Phe
Ser Val Glu Leu Pro Asp Gly Asn Tyr Cys Asp Ile Leu Gly Ala Thr Asp Pro Lys Asn Asn Pro Cys
Gly Ala Asp Val Thr Val Ser Gly Gly Lys Ala Thr Phe Thr Ile Pro Ala Lys Thr Ala Val Ala Ile
Cys Thr Asp Glu Lys Trp Cys Gly Lys Gly Val Asp Pro Cys Glu Ser Asp Pro Thr Gly Ser Ala Cys
Val Cys Lys Gly Glu Thr Thr Val Asn Gly Val Cys Val Ser Trp Cys Asn Ala His Ser Ser Asn Glu
Glu Cys Ala Cys Val Leu Asn Pro Asn Asp Ala Glu Cys Gln Ala Asp Ile Glu Pro Thr Lys Gly Lys
Leu Cys Tyr Val Gly Thr Ser Asn Lys Trp Thr Gln Glu Pro Leu Thr Tyr Asn Arg Lys Thr Gly Phe
Trp Thr Leu Asn Val Glu Leu Asp Gly Lys Gly Asp Thr Ser Gly Ala Gln Arg Phe Lys Val Thr
Asp Gly Cys Ser Trp Gln Gly Thr Val Tyr Gly Ser Ser Gly Val Glu Gly Arg Leu Asp Val Asn Thr
Ser Ala Thr Gly Asp Glu Pro Val Ser Leu Thr Gly Lys Tyr Val Leu Ser Ile Asn Asp Lys Thr Met
Glu Tyr Thr Phe Ile Pro Ala Gly Ser Gly Asn Lys Pro Pro Val Ala Ser Phe Thr Pro Thr Val Lys
Asp Leu Thr Val Ser Phe Val Asn Asn Ser Ser Asp Pro Glu Asn Asp Glu Leu Thr Tyr Ser Trp Asn
Phe Gly Asn Gly Lys Thr Ser Ser Glu Lys Asn Pro Ser Val Thr Tyr Asp Lys Ala Gly Lys Tyr Thr
Val Ser Leu Lys Val Thr Asp Thr Ala Asn Asn Thr Asp Thr Lys Thr Leu Glu Ile Asp Leu Thr Ser
Pro Val Asn Gly Lys Tyr Ser Lys Val Ala Val Arg Gly Ser His Asp Asn Tyr Gly Thr Asn Leu Leu
Thr Arg Asn Gly Ser Glu Trp Thr Gly Ile Phe Glu Phe Ser Lys Thr Thr Lys Phe Lys Leu Glu Ala
Leu Pro Pro Ala Ala Asp Gln Cys Ile Phe Leu Gly Gly Asn Arg Gly Glu Ala Leu Thr Ala Ser Gly
Gly Phe Ile Ser Leu Pro Ala Gly Arg Tyr Thr Ile Lys Phe Asn Glu Glu Ser Lys Val Leu Thr Ala
Gly Asp Val Asp Cys Thr Gly

SEQ ID NO: 151
atgaaaactattctttcaacaatcatggtgatggcggctgcggctgccaccaccgtagaggctcaaggctggccggaaaactacggcggcgtc
atgttgcagggattctactgggattcctattcagccaccaagtggactaaactggaagcacaggctgacgagatctgcaactatttctcgctggta
tgggtaccacagtcggcctataccggcagcagtacctccatgggctacgacccgctgtattacttcgaccagcattcatcgttcggcaccgaag
agcagctacggtcgttcatcagtacctacaagcagaaaggaactggcatcatagccgatgtagttgtcaatacccgaaagaatgtctcaaactg
ggtggatttcccggccgagacctacaacggtgtaacctatcagatggtaagcaccgacatcgtttcgaacgatgacggcggaaaaacagcca
cttgggcaaatcaaaacggctacagtctctcctccaatgccgacgaaggcgaaggctgggacggcatgcgcgacctggaccacaagtcgca
gaacgtgcagaaatcggttcttgcctacaccaaatatctggttgacgacttaggctataccggattccgctacgatatggtaaagggatttgacgg
atcgcatgtagccgactacaacaccaatgccggcgtgcagttctctgtcggcgaatattgggacggcactgcatcgaaagtttacagttggatca
acagcaccaaaaagagcgatgtgccgcagtcggcagccttcgacttcgctttccgatacacctgccgcgatgccgtcaacaacaagaactgg
gcgaacctgaagaacacttccggtatcagcgatgccgattacaggcgctattcggttacgtttgttgaaaatcacgatacggaataccgttcagct
acggcttcccaggatcccatcaagggtgatacggttgccctcaatgcctggatgctggctatgccgggcacaccttgtgttttcctgaaacattgg
accgactgcaaggaagagatcaagaatctcatcgaggcacgtcgcctggtcggtattcacaaccagagcacctatgccgaatggatgagcgg
tgcagcctacatcggacgtaccgtaacaggtacgaacggcaccttacgtgttctgtgcggctcttatcagtataatgtagccgccaactacattca
gattctctcaggcaaaaactataaatactacgtactcaacacgctcgaggctccctggatcgggaaaggttccggctcgtacaccgaaggtgaa
accgtaacggttccgctcatcgccatatcggccgatgccaatgccaagctggtatataccaccgacggcacagaccccaccgcaacctcaaca
gccgtaaccagcggaacggaactgaccatcacttcggacgccgtcctgaaggttggtctgctttccggcggcatcgtcaggaacatacagagc
cgtacattcaccttccaggctgcaaacacctccgagtattacacagccaccatgcacgtatgcaaccagtccggagctctcaatccgctgttgc
ctatgtttgggcaggaccggacaacgagcagattaacggcaactggccgggcaccaagctcaccgctaccattaccgaaaacaaccttacct

Figure 16JJJ ggtacacgcagtcgttccagattccgaagaacgtggactatgtcgtgaactttgttttcaccacaaccggcggcggtacgcagacagtggatgtt
accggcatgaaggccgatgtctggtacattattaacagtaccaagagccggcaacaagtacacggtaaccgacgttaccctcacagtattcttcgtt
agaggccatctttgatgaagaaaactccggctccttccctgtctatgacctgcagggacgccgcgtcagcgaaattagaaacaggacaattatat
cttcagaacggaaagaagatactcatcagataaacagaggttccgaaccattctcctattatgaaaatcagacacttagtaatctcagcactgctg
ggtttgggggcttgtacaccatcagctgctcctcgtcggg SEQ ID NO: 152
Met Lys Thr Ile Leu Ser Thr Ile Met Val Met Ala Ala Ala Ala Ala Thr Thr Val Glu Ala Gln Gly
Trp Pro Glu Asn Tyr Gly Gly Val Met Leu Gln Gly Phe Tyr Trp Asp Ser Tyr Ser Ala Thr Lys Trp
Thr Lys Leu Glu Ala Gln Ala Asp Glu Ile Cys Asn Tyr Phe Ser Leu Val Trp Val Pro Gln Ser Ala
Tyr Thr Gly Ser Ser Thr Ser Met Gly Tyr Asp Pro Leu Tyr Tyr Phe Asp Gln His Ser Ser Phe Gly
Thr Glu Glu Gln Leu Arg Ser Phe Ile Ser Thr Tyr Lys Gln Lys Gly Thr Gly Ile Ile Ala Asp Val Val
Val Asn His Arg Lys Asn Val Ser Asn Trp Val Asp Phe Pro Ala Glu Thr Tyr Asn Gly Val Thr Tyr
Gln Met Val Ser Thr Asp Ile Val Ser Asn Asp Asp Gly Gly Lys Thr Ala Thr Trp Ala Asn Gln Asn
Gly Tyr Ser Leu Ser Ser Asn Ala Asp Glu Gly Glu Gly Trp Asp Gly Met Arg Asp Leu Asp His
Lys Ser Gln Asn Val Gln Lys Ser Val Leu Ala Tyr Thr Lys Tyr Leu Val Asp Asp Leu Gly Tyr Thr
Gly Phe Arg Tyr Asp Met Val Lys Gly Phe Asp Gly Ser His Val Ala Asp Tyr Asn Thr Asn Ala
Gly Val Gln Phe Ser Val Gly Glu Tyr Trp Asp Gly Thr Ala Ser Lys Val Tyr Ser Trp Ile Asn Ser
Thr Lys Lys Ser Asp Val Pro Gln Ser Ala Ala Phe Asp Phe Ala Phe Arg Tyr Thr Cys Arg Asp Ala
Val Asn Asn Lys Asn Trp Ala Asn Leu Lys Asn Thr Ser Gly Ile Ser Asp Ala Asp Tyr Arg Arg Tyr
Ser Val Thr Phe Val Glu Asn His Asp Thr Glu Tyr Arg Ser Ala Thr Ala Ser Gln Asp Pro Ile Lys
Gly Asp Thr Val Ala Leu Asn Ala Trp Met Leu Ala Met Pro Gly Thr Pro Cys Val Phe Leu Lys His
Trp Thr Asp Cys Lys Glu Glu Ile Lys Asn Leu Ile Glu Ala Arg Arg Leu Val Gly Ile His Asn Gln
Ser Thr Tyr Ala Glu Trp Met Ser Gly Ala Ala Tyr Ile Gly Arg Thr Val Thr Gly Thr Asn Gly Thr
Leu Arg Val Leu Cys Gly Ser Tyr Gln Tyr Asn Val Ala Ala Asn Tyr Ile Gln Ile Leu Ser Gly Lys
Asn Tyr Lys Tyr Tyr Val Leu Asn Thr Leu Glu Ala Pro Trp Ile Gly Lys Gly Ser Gly Ser Tyr Thr
Glu Gly Glu Thr Val Thr Val Pro Leu Ile Ala Ile Ser Ala Asp Ala Asn Ala Lys Leu Val Tyr Thr
Thr Asp Gly Thr Asp Pro Thr Ala Thr Ser Thr Ala Val Thr Ser Gly Thr Glu Leu Thr Ile Thr Ser
Asp Ala Val Leu Lys Val Gly Leu Leu Ser Gly Gly Ile Val Arg Asn Ile Gln Ser Arg Thr Phe Thr
Phe Gln Ala Ala Asn Thr Ser Glu Tyr Tyr Thr Ala Thr Met His Val Cys Asn Gln Ser Gly Ala Leu
Asn Pro Leu Phe Ala Tyr Val Trp Ala Gly Pro Asp Asn Glu Gln Ile Asn Gly Asn Trp Pro Gly Thr
Lys Leu Thr Ala Thr Ile Thr Glu Asn Asn Leu Thr Trp Tyr Thr Gln Ser Phe Gln Ile Pro Lys Asn
Val Asp Tyr Val Val Asn Phe Val Phe Thr Thr Thr Gly Gly Gly Thr Gln Thr Val Asp Val Thr Gly
Met Lys Ala Asp Val Trp Tyr Ile Ile Asn Ser Thr Lys Ser Gly Asn Lys Tyr Thr Val Thr Asp Val
Thr Ser Gln Tyr Ser Ser Leu Glu Ala Ile Phe Asp Glu Glu Asn Ser Gly Ser Phe Pro Val Tyr Asp
Leu Gln Gly Arg Arg Val Ser Glu Ile Arg Asn Arg Thr Ile Ile Ser Ser Glu Arg Lys Glu Asp Thr
His Gln Ile Asn Arg Gly Ser Glu Pro Phe Ser Tyr Glu Asn Gln Thr Leu Ser Asn Leu Ser Thr
Ala Gly Phe Gly Gly Leu Val His His Gln Leu Leu Leu Val Gly SEQ ID NO: 69
atgttgaaaaggattacggtagtctgtttattgttattttgcttttccctaatatatatgagggaaataaggcagaagcagcaacagtgaacaatgga
acattaatgcagtattttgagtggtacgctccgaatgatgggaatcattggaatcgtttgcgttccgatgctgaaagtttagctcataaaggaatcac
atctgtatggataccacctgcatataaagggacttcgcaaaatgatgtagggtatggggcctatgatttatatgatttaggggagttcaatcaaaaa
ggaacggtgcggacgaaatatgggacaaaagcacagttgaaatctgcaattgacgctttacataagcaaaacatcgacgtatacggtgatgtag
ttatgaatcataaaggtggggctgattatactgaaaccgtaacagctgttgaggtagaccgtaacaatcgaaatattgaagtatcaggtgattatca
aattagtgcatggacgggggtttaattttccagggcgcggagatgcttattctaatttcaaatggaaatggtatcattttgacggaacggattgggatg
aaggaaggaaattaaatcgaattttataaatttagggggtgtagataaagcgtgggattgggaagtgtctagcgaaaatggaaattatgattatttgat
gtatgcagatcttgattttgatcatcctgatgttgcgaatgagatgaaaaattggggaacatggtatgcgaatgaattaaatttagatggctttcgttt
ggacgctgttaaacatattgatcatgaatatttacgcgattgggtaaatcatgccagacagcaaacggggaaagaaatgtttacagtagctgaata
ttggcaaaatgatgttcaggctttaaacaattatttagcgaaagtcaattataatcaatctgtgtttgatgcaccgcttcattacaattttcattatgcttc

Figure 16KKK aacaggaaatgggaattatgatatgagaaatattttaaatggaacagtaatgaaaaatcaccctgcactcgcagttactctcgttgagaatcatgat
tctcagcctgggcagtcattggaatctgtagtaagtccgtggtttaagccgctggcatatgcatttattttaactcgtgcagagggctatccttcagtt
ttctatggtgattactatgggacaagcggaaatagtagttatgaaattccagcgttaaaagataaaattgatccaattttgacggcacgaaaaaactt
tgcatatggtacgcagcgtgattatttagaccatccagatgtgattggctggacaagagaaggcgatggtgtacatgctaattctggtttagcgac
attactctcggacggaccaggaggatcaaagtggatggatgttggaaagaataacgctggggaagtatggtacgatattacgggtaatcaaac
aaatactgtaacaattaataaggacggatgggggcagttctatgtaagtggcggctcagtttccatatatgttcagcggtaa SEQ ID NO: 70
Met Leu Lys Arg Ile Thr Val Val Cys Leu Leu Phe Ile Leu Leu Phe Pro Asn Ile Tyr Glu Gly Asn
Lys Ala Glu Ala Ala Thr Val Asn Asn Gly Thr Leu Met Gln Tyr Phe Glu Trp Tyr Ala Pro Asn Asp
Gly Asn His Trp Asn Arg Leu Arg Ser Asp Ala Glu Ser Leu Ala His Lys Gly Ile Thr Ser Val Trp
Ile Pro Pro Ala Tyr Lys Gly Thr Ser Gln Asn Asp Val Gly Tyr Gly Ala Tyr Asp Leu Tyr Asp Leu
Gly Glu Phe Asn Gln Lys Gly Thr Val Arg Thr Lys Tyr Gly Thr Lys Ala Gln Leu Lys Ser Ala Ile
Asp Ala Leu His Lys Gln Asn Ile Asp Val Tyr Gly Asp Val Val Met Asn His Lys Gly Gly Ala Asp
Tyr Thr Glu Thr Val Thr Ala Val Glu Val Asp Arg Asn Asn Arg Asn Ile Glu Val Ser Gly Asp Tyr
Gln Ile Ser Ala Trp Thr Gly Phe Asn Phe Pro Gly Arg Gly Asp Ala Tyr Ser Asn Phe Lys Trp Lys
Trp Tyr His Phe Asp Gly Thr Asp Trp Asp Glu Gly Arg Lys Leu Asn Arg Ile Tyr Lys Phe Arg Gly
Val Asp Lys Ala Trp Asp Trp Glu Val Ser Ser Glu Asn Gly Asn Tyr Asp Tyr Leu Met Tyr Ala Asp
Leu Asp Phe Asp His Pro Asp Val Ala Asn Glu Met Lys Asn Trp Gly Thr Trp Tyr Ala Asn Glu
Leu Asn Leu Asp Gly Phe Arg Leu Asp Ala Val Lys His Ile Asp His Glu Tyr Leu Arg Asp Trp Val
Asn His Ala Arg Gln Gln Thr Gly Lys Glu Met Phe Thr Val Ala Glu Tyr Trp Gln Asn Asp Val Gln
Ala Leu Asn Asn Tyr Leu Ala Lys Val Asn Tyr Asn Gln Ser Val Phe Asp Ala Pro Leu His Tyr Asn
Phe His Tyr Ala Ser Thr Gly Asn Gly Asn Tyr Asp Met Arg Asn Ile Leu Asn Gly Thr Val Met Lys
Asn His Pro Ala Leu Ala Val Thr Leu Val Glu Asn His Asp Ser Gln Pro Gly Gln Ser Leu Glu Ser
Val Val Ser Pro Trp Phe Lys Pro Leu Ala Tyr Ala Phe Ile Leu Thr Arg Ala Glu Gly Tyr Pro Ser
Val Phe Tyr Gly Asp Tyr Tyr Gly Thr Ser Gly Asn Ser Ser Tyr Glu Ile Pro Ala Leu Lys Asp Lys
Ile Asp Pro Ile Leu Thr Ala Arg Lys Asn Phe Ala Tyr Gly Thr Gln Arg Asp Tyr Leu Asp His Pro
Asp Val Ile Gly Trp Thr Arg Glu Gly Asp Gly Val His Ala Asn Ser Gly Leu Ala Thr Leu Leu Ser
Asp Gly Pro Gly Gly Ser Lys Trp Met Asp Val Gly Lys Asn Asn Ala Gly Glu Val Trp Tyr Asp Ile
Thr Gly Asn Gln Thr Asn Thr Val Thr Ile Asn Lys Asp Gly Trp Gly Gln Phe Tyr Val Ser Gly Gly
Ser Val Ser Ile Tyr Val Gln Arg SEQ ID NO: 153
ttgccttcaattaatgcaagcgattgcaaaaaaagggagataggagtatgaagaggaaaaaatggactgcgttagcactatctttaccactagtt
atgagcttatcaacaaacatacaagcagaaacattacataataataagggtcaaaaggcgcaaacaggaaataaagacggaattttttatgaact
gtatgttaattcttttatgatactgatagcaatggacatggtgatttaaaaggcgtcacaaagaaacttgattatttaaatgatggaaatccaagaac
aaataatgatcttcaaataaacggtatctggatgatgcctattaacacctctcctagttatcacaaatatgatgtaacagattactataatatcgatcct
cagtatggaagtttacaagatttccgtgaactaacaacagaagcgcataaacgcaacgtaaaggtagtaatagatcttgttattaatcatacaagc
agtgagcatccttggtttgtcgatgcattaaaaaataaaaacagtaagtatcgagattactatatttgggctgataaaaatacagacttaaatgaaaa
aggcccatggggtcaacaagtatggcacaaagcgtcgaacggagagtatttctacgcaacgttctgggaagggatgccggacttaaactatga
caacccctaaagtaagagaagaaatgattaaaatcgggaaattttggctcaaacaaggagctgatggctttcgtctagatgcagccatgcacatctt
taaagggcaaacacctgaaggagcaaagaaaaatattgaatggtggaatgaattccgcgacgcgatgagagaaacgaatccaaatacgtatct
agttggtgaaatatgggatcaaccagaagtagttgctccgtattatcaatcgttagattctacatttaacttcgacttagcatataaaatcgttaattcc
gttaaaaatggtactgatcaaggggtagccgcggcagctgttgcaacggatgagttatataaaacatataatccaaataaaattgatggaacgttt
ttaacgaatcatgaccaaaatcgtgtaatgagtgagttaaatggtgatgtaaacaaagcaaaatcagcagcctctattctgttgacactccctggta
atccgttcatttattatggcgaagaaatcggcatgacaggccaaaaaccagatgagttgattcgtgagcctttccgttggtatgaagatgataaag
aaggtcaaacgagctgggagactccagtatataacattgatcataatggtgtttcagttgaagcacaagataaacaaaaagcttctcttctaagcc
attatcgtaaaatgattcgtgttcgtcagcaacacgatgaacttgtcaaaggtaatttagaacctatttctgtcaataattcacaggttgttgcctataat
cgtacgtataaaaataaatcaattcaagtgtaccataatatttcagacaagccggttacattaactgtttcaaacaaaggaaaactgattttttctagt
gaattaggagcaaaaaaggaaaaatcaacattagtaattccagcgaatacgacagtgctagtaaagtaa

Figure 16LLL

SEQ ID NO: 154

Met Pro Ser Ile Asn Ala Ser Asp Cys Lys Lys Gly Asp Arg Ser Met Lys Arg Lys Lys Trp Thr
Ala Leu Ala Leu Ser Leu Pro Leu Val Met Ser Leu Ser Thr Asn Ile Gln Ala Glu Thr Leu His Asn
Asn Lys Gly Gln Lys Ala Gln Thr Gly Asn Lys Asp Gly Ile Phe Tyr Glu Leu Tyr Val Asn Ser Phe
Tyr Asp Thr Asp Ser Asn Gly His Gly Asp Leu Lys Gly Val Thr Lys Lys Leu Asp Tyr Leu Asn
Asp Gly Asn Pro Arg Thr Asn Asn Asp Leu Gln Ile Asn Gly Ile Trp Met Met Pro Ile Asn Thr Ser
Pro Ser Tyr His Lys Tyr Asp Val Thr Asp Tyr Tyr Asn Ile Asp Pro Gln Tyr Gly Ser Leu Gln Asp
Phe Arg Glu Leu Thr Thr Glu Ala His Lys Arg Asn Val Lys Val Val Ile Asp Leu Val Ile Asn His
Thr Ser Ser Glu His Pro Trp Phe Val Asp Ala Leu Lys Asn Lys Asn Ser Lys Tyr Arg Asp Tyr Tyr
Ile Trp Ala Asp Lys Asn Thr Asp Leu Asn Glu Lys Gly Pro Trp Gly Gln Gln Val Trp His Lys Ala
Ser Asn Gly Glu Tyr Phe Tyr Ala Thr Phe Trp Glu Gly Met Pro Asp Leu Asn Tyr Asp Asn Pro Lys
Val Arg Glu Glu Met Ile Lys Ile Gly Lys Phe Trp Leu Lys Gln Gly Ala Asp Gly Phe Arg Leu Asp
Ala Ala Met His Ile Phe Lys Gly Gln Thr Pro Glu Gly Ala Lys Lys Asn Ile Glu Trp Trp Asn Glu
Phe Arg Asp Ala Met Arg Glu Thr Asn Pro Asn Thr Tyr Leu Val Gly Glu Ile Trp Asp Gln Pro Glu
Val Val Ala Pro Tyr Tyr Gln Ser Leu Asp Ser Thr Phe Asn Phe Asp Leu Ala Tyr Lys Ile Val Asn
Ser Val Lys Asn Gly Thr Asp Gln Gly Val Ala Ala Ala Ala Val Ala Thr Asp Glu Leu Tyr Lys Thr
Tyr Asn Pro Asn Lys Ile Asp Gly Thr Phe Leu Thr Asn His Asp Gln Asn Arg Val Met Ser Glu Leu
Asn Gly Asp Val Asn Lys Ala Lys Ser Ala Ala Ser Ile Leu Leu Thr Leu Pro Gly Asn Pro Phe Ile
Tyr Tyr Gly Glu Glu Ile Gly Met Thr Gly Gln Lys Pro Asp Glu Leu Ile Arg Glu Pro Phe Arg Trp
Tyr Glu Asp Asp Lys Glu Gly Gln Thr Ser Trp Glu Thr Pro Val Tyr Asn Ile Asp His Asn Gly Val
Ser Val Glu Ala Gln Asp Lys Gln Lys Ala Ser Leu Leu Ser His Tyr Arg Lys Met Ile Arg Val Arg
Gln Gln His Asp Glu Leu Val Lys Gly Asn Leu Glu Pro Ile Ser Val Asn Asn Ser Gln Val Val Ala
Tyr Asn Arg Thr Tyr Lys Asn Lys Ser Ile Gln Val Tyr His Asn Ile Ser Asp Lys Pro Val Thr Leu
Thr Val Ser Asn Lys Gly Lys Leu Ile Phe Ser Ser Glu Leu Gly Ala Lys Lys Glu Lys Ser Thr Leu
Val Ile Pro Ala Asn Thr Thr Val Leu Val Lys

SEQ ID NO: 155 gtgtcaagaatgtttgcaaaacgattcaaaacctctttactgccgttattcgctggatttttattgctgtttcatttggttctggcaggaccaacggctg
cgaatgctgaaacggctaacaaatcaaatgagcttacagcaccgtcgatcaaaagcggaaccattcttcatgcttggaattggtcgttcaatacgt
taaaacacaatatgaaggatattcatgatgcaggatatacagcgattcagacgtctccgattaaccaagtcaaggaagggaaccaaggaaataa
aaacatgtcgaactggtactggctctatcagccgacatcgtaccaaattggcaaccgttacttaggtactgaacaagaatttaaagaaatgtgtgc
agccgctgaagaatatggcataaaggttattgttgacgcggtcatcaatcataccaccagtgactatgccgcgatttccaatgagattaagagtatt
ccaaactggacacatggaaacacacaaattaaaaactggtctgatcgatgggatgtcacgcagaatgcattgctcgggctgtatgactggaata
cacaaaatacacaagtacagtcctatttgaaacggttcttagaaagagcattgaatgacggggcagacggttttcgatttgatgccgccaaacata
tagagcttccggatgatggcagttacggcagtcaattttggccgaatatcacaaatacatctgcagagttccaatacggagaaatcctgcaggat
agtgcttcaagagatgcttcatatgcgaattatatgaatgtgacagcgtctaactatgggcattccataaggtccgctttaaagaatcgtaatctggg
cgtgtcgaatatctcccactatgcatcagatgtgtctgcggacaagctagtgacatgggtagaatcgcatgatacgtatgccaatgatgatgaag
agtcgacatggatgagcgatgatgatatccgtttaggctgggcggtgatagcttctcgttcaggcagtacgcctcttttcttttccagacctgaggg
aggcggaaatggtgtgagattcccggggaaaagccaaataggcgatcgcgggagtgctttatttgaagatcaggctatcactgcggtcaatag
atttcacaatgtgatggctggacagcctgaggaactctcgaacccaaatggaaacaaccagatatttatgaatcagcgcggctcacatggcgttg
tgctggcaaatgcaggttcatcctctgtttctatcaatacgccaacaaaattgcctgatggcaggtatgataataaagctggggcaggttcatttca
agtaaatgacggtaaactgacaggcacgatcaatgccaggtctgtggctgtgctttatcctgatgatattgcaaaagcgcctcatgttttccttgag
aattacaaaacaggtgtaacacattctttcaatgatcaactgacgattacactgcgtgcagatgcgaatacaacaaaagccgtttatcaaatcaata
atggaccagagacggcgtttaaggatggagatcaattcacaatcggaaaaggagatccatttggcaaaacatacaccatcatgttaaaaggaac
gaacagtgatggtgtaacgaggaccgaggaatacagttttgttaaaagagatccagcttcggccaaaaccatcggctatcaaaatccgaatcatt
ggagccaggtaaatgcttatatctataaacatgatgggggccgggca

SEQ ID NO: 156

Figure 16MMM

Val Ser Arg Met Phe Ala Lys Arg Phe Lys Thr Ser Leu Leu Pro Leu Phe Ala Gly Phe Leu Leu Leu
Phe His Leu Val Leu Ala Gly Pro Thr Ala Ala Asn Ala Glu Thr Ala Asn Lys Ser Asn Glu Leu Thr
Ala Pro Ser Ile Lys Ser Gly Thr Ile Leu His Ala Trp Asn Trp Ser Phe Asn Thr Leu Lys His Asn
Met Lys Asp Ile His Asp Ala Gly Tyr Thr Ala Ile Gln Thr Ser Pro Ile Asn Gln Val Lys Glu Gly
Asn Gln Gly Asn Lys Asn Met Ser Asn Trp Tyr Trp Leu Tyr Gln Pro Thr Ser Tyr Gln Ile Gly Asn
Arg Tyr Leu Gly Thr Glu Gln Glu Phe Lys Glu Met Cys Ala Ala Ala Glu Glu Tyr Gly Ile Lys Val
Ile Val Asp Ala Val Ile Asn His Thr Thr Ser Asp Tyr Ala Ala Ile Ser Asn Glu Ile Lys Ser Ile Pro
Asn Trp Thr His Gly Asn Thr Gln Ile Lys Asn Trp Ser Asp Arg Trp Asp Val Thr Gln Asn Ala Leu
Leu Gly Leu Tyr Asp Trp Asn Thr Gln Asn Thr Gln Val Gln Ser Tyr Leu Lys Arg Phe Leu Glu
Arg Ala Leu Asn Asp Gly Ala Asp Gly Phe Arg Phe Asp Ala Ala Lys His Ile Glu Leu Pro Asp Asp
Gly Ser Tyr Gly Ser Gln Phe Trp Pro Asn Ile Thr Asn Thr Ser Ala Glu Phe Gln Tyr Gly Glu Ile
Leu Gln Asp Ser Ala Ser Arg Asp Ala Ser Tyr Ala Asn Tyr Met Asn Val Thr Ala Ser Asn Tyr Gly
His Ser Ile Arg Ser Ala Leu Lys Asn Arg Asn Leu Gly Val Ser Asn Ile Ser His Tyr Ala Ser Asp
Val Ser Ala Asp Lys Leu Val Thr Trp Val Glu Ser His Asp Thr Tyr Ala Asn Asp Asp Glu Glu Ser
Thr Trp Met Ser Asp Asp Asp Ile Arg Leu Gly Trp Ala Val Ile Ala Ser Arg Ser Gly Ser Thr Pro
Leu Phe Phe Ser Arg Pro Glu Gly Gly Gly Asn Gly Val Arg Phe Pro Gly Lys Ser Gln Ile Gly Asp
Arg Gly Ser Ala Leu Phe Glu Asp Gln Ala Ile Thr Ala Val Asn Arg Phe His Asn Val Met Ala Gly
Gln Pro Glu Glu Leu Ser Asn Pro Asn Gly Asn Asn Gln Ile Phe Met Asn Gln Arg Gly Ser His Gly
Val Val Leu Ala Asn Ala Gly Ser Ser Ser Val Ser Ile Asn Thr Pro Thr Lys Leu Pro Asp Gly Arg
Tyr Asp Asn Lys Ala Gly Ala Gly Ser Phe Gln Val Asn Asp Gly Lys Leu Thr Gly Thr Ile Asn Ala
Arg Ser Val Ala Val Leu Tyr Pro Asp Asp Ile Ala Lys Ala Pro His Val Phe Leu Glu Asn Tyr Lys
Thr Gly Val Thr His Ser Phe Asn Asp Gln Leu Thr Ile Thr Leu Arg Ala Asp Ala Asn Thr Thr Lys
Ala Val Tyr Gln Ile Asn Asn Gly Pro Glu Thr Ala Phe Lys Asp Gly Asp Gln Phe Thr Ile Gly Lys
Gly Asp Pro Phe Gly Lys Thr Tyr Thr Ile Met Leu Lys Gly Thr Asn Ser Asp Gly Val Thr Arg Thr
Glu Glu Tyr Ser Phe Val Lys Arg Asp Pro Ala Ser Ala Lys Thr Ile Gly Tyr Gln Asn Pro Asn His
Trp Ser Gln Val Asn Ala Tyr Ile Tyr Lys His Asp Gly Gly Arg Ala

SEQ ID NO: 157
atgcaaacgattgcaaaaaaaggggatgaaacgatgaaagggaaaaaatggacagcattagctctaacactgccgctggctgctagcttatca
acaggcgttcacgccgaaaccgtacataaaggtaaagctccaacagcagataaaaacggtgtcttttatgaggtgtatgtaaactcttttacgat
gcaaataaagatggacatggtgatttaaaaggtcttacacaaaagctggattatttgaatgacggcaattctcataccaaaaatgatcttcaagtaa
acggaatttggatgatgccggtaaaccctictcctagctatcataaatatgatgtaacggactattataacattgatccgcagtacggaaatctgca
agattttcgcaagctgatgaaagaagcagataaaacgagacgtaaaggttattatggacctcgttgtgaatcatacaagcagtgaacatccttggtt
tcaagctgcattaaaagataaaaacagcaagtacagagattactatatttgggccgataaaaaatactgatttaaatgaaaaaggatcttgggggca
gcaagtatggcataaagctccaaacggagagtattttatggtacgttttgggaaggaatgcctgacttaaattacgataatcccgaagtaagaaa
agaaatgattaacgtcgggaaattttggctaaagcaaggcgttgacgggttccgcttagatgctgcgcttcatatttttaaaggtcaaacacctgaa
ggcgctaagaaaaatatcgtgtggtggaatgagtttagagatgcaatgaaaaaagaaaaccctaacgtatatctaacgggtgaagtatgggatc
aaccggaagtagtagctccttactatcaatcgcttgattctttatttaactttgatttagcaggaaagattgtaaactctgtaaaatcaggaaatgatca
aggaatcgcgactgcagcagccgcaactgatgagctgttcaaatcatacaatccaaataaaattgacggcatttttcttaaccaaccatgaccaaa
atcgcgtcatgagtgagctaagcggcgatgtgaataaagcaaagtcagctgcctctatcttacttacgcttcctggcaacccgtatatttattacgg
tgaagaaattggaatgaccggtgaaaagcctgatgagttaatccgtgaaccgttccgctggtacgaaggcaatggacttggacaaaccagctg
ggaaacatccgtatacaacaaaggcggcaatggtgtgtcagtagagacacaaacaaaacaaaaggattcttttgttaaatcattaccgtgaaatga
ttcgcgtgcgtcagcagcatgaagagttagtaaaaggaacccttcaatctatttcagtagacagtaaagaagtcgttgcctatagccgcacgtata
aaggcaaatcgattagcgtgtatcataatatttcaaatcaaccggtaaaagtatctgtaacagcgaaaggtaaattgattttgctagtgaaaaaggt
gcaaaaaaagtcaaaaatcagcttgtggttccagctaatacaacggttttaataaaataa SEQ ID NO: 158
Met Gln Thr Ile Ala Lys Lys Gly Asp Glu Thr Met Lys Gly Lys Lys Trp Thr Ala Leu Ala Leu Thr
Leu Pro Leu Ala Ala Ser Leu Ser Thr Gly Val His Ala Glu Thr Val His Lys Gly Lys Ala Pro Thr
Ala Asp Lys Asn Gly Val Phe Tyr Glu Val Tyr Val Asn Ser Phe Tyr Asp Ala Asn Lys Asp Gly His

Figure 16NNN

Gly Asp Leu Lys Gly Leu Thr Gln Lys Leu Asp Tyr Leu Asn Asp Gly Asn Ser His Thr Lys Asn
Asp Leu Gln Val Asn Gly Ile Trp Met Met Pro Val Asn Pro Ser Pro Ser Tyr His Lys Tyr Asp Val
Thr Asp Tyr Tyr Asn Ile Asp Pro Gln Tyr Gly Asn Leu Gln Asp Phe Arg Lys Leu Met Lys Glu Ala
Asp Lys Arg Asp Val Lys Val Ile Met Asp Leu Val Val Asn His Thr Ser Ser Glu His Pro Trp Phe
Gln Ala Ala Leu Lys Asp Lys Asn Ser Lys Tyr Arg Asp Tyr Tyr Ile Trp Ala Asp Lys Asn Thr Asp
Leu Asn Glu Lys Gly Ser Trp Gly Gln Gln Val Trp His Lys Ala Pro Asn Gly Glu Tyr Phe Tyr Gly
Thr Phe Trp Glu Gly Met Pro Asp Leu Asn Tyr Asp Asn Pro Glu Val Arg Lys Glu Met Ile Asn Val
Gly Lys Phe Trp Leu Lys Gln Gly Val Asp Gly Phe Arg Leu Asp Ala Ala Leu His Ile Phe Lys Gly
Gln Thr Pro Glu Gly Ala Lys Lys Asn Ile Val Trp Trp Asn Glu Phe Arg Asp Ala Met Lys Lys Glu
Asn Pro Asn Val Tyr Leu Thr Gly Glu Val Trp Asp Gln Pro Glu Val Val Ala Pro Tyr Tyr Gln Ser
Leu Asp Ser Leu Phe Asn Phe Asp Leu Ala Gly Lys Ile Val Asn Ser Val Lys Ser Gly Asn Asp Gln
Gly Ile Ala Thr Ala Ala Ala Ala Thr Asp Glu Leu Phe Lys Ser Tyr Asn Pro Asn Lys Ile Asp Gly
Ile Phe Leu Thr Asn His Asp Gln Asn Arg Val Met Ser Glu Leu Ser Gly Asp Val Asn Lys Ala Lys
Ser Ala Ala Ser Ile Leu Leu Thr Leu Pro Gly Asn Pro Tyr Ile Tyr Tyr Gly Glu Glu Ile Gly Met Thr
Gly Glu Lys Pro Asp Glu Leu Ile Arg Glu Pro Phe Arg Trp Tyr Glu Gly Asn Gly Leu Gly Gln Thr
Ser Trp Glu Thr Ser Val Tyr Asn Lys Gly Gly Asn Gly Val Ser Val Glu Thr Gln Thr Lys Gln Lys
Asp Ser Leu Leu Asn His Tyr Arg Glu Met Ile Arg Val Arg Gln Gln His Glu Glu Leu Val Lys Gly
Thr Leu Gln Ser Ile Ser Val Asp Ser Lys Glu Val Val Ala Tyr Ser Arg Thr Tyr Lys Gly Lys Ser Ile
Ser Val Tyr His Asn Ile Ser Asn Gln Pro Val Lys Val Ser Val Thr Ala Lys Gly Lys Leu Ile Phe Ala
Ser Glu Lys Gly Ala Lys Lys Val Lys Asn Gln Leu Val Val Pro Ala Asn Thr Thr Val Leu Ile Lys

SEQ ID NO: 159
ttgcaaaaaaaagggggatgaaacgatgaaagggaaaaaatggacagctttagctctaacactgccgctggctgctagcttatcaacaggcgttc
acgccgaaaccgtacataaaggtaaatctccaacagcagataaaaacggtgtattttatgaggtgtatgtaaactcttttacgatgcaaataaaga
tggacatggtgatttaaaaggtcttacacaaaagttggattatttaaatgatggcaattctcatacaaagaatgatcttcaagtaaacgggatttggat
gatgccggtcaaccttctcccagctatcataaatatgatgtaacggactattataatattgatccgcagtatggaaatctgcaagattttcgcaaac
tgatgaaagaagcagataaacgagatgtaaaagtcattatggacctcgttgtgaatcatacgagcagtgaacacccttggtttcaagctgcattaa
aagataaaaacagcaagtacagagattactatatctgggctgataaaaataccgacttgaatgaaaaaaggatcttggggacagcaagtatggca
taaagctccaaacggagagtattttacggaacgttttgggaaggaatgccggacttaaattacgataatcctgaagtaagaaaagaaatgattaa
cgtaggaaagtttttggctaaagcaaggagttgatggggttccgtctagatgctgcgcttcatattttaaaggccaaacacctgaaggcgctaagaa
aaatctcctgtggtggaatgaatttagagatgcaatgaaaaaggaaaacccaacgtatatctaacgggtgaagtatgggatcaaccggaagta
gtagctccttactatcaatcgcttgattctttatttaactttgatttagcaggaaagattgtaaactctgtaaaatcaggaaatgatcaaggaatcgcga
ctgcagcagcggcaacggatgaactgttcaaatcatacaatccaaataaaattgacggtatttttcttaaccaaccatgaccaaaatcgcgtcatga
gtgagctaaacggcgatgtgaataaagcaaagtcagctgcctctatcttacttacgcttcctggcaacccgtatatttattacggtgaagaaatcgg
catgaccggtgaaaagcctgatgagttaatccgtgaaccgttccctggtacgaaggaaacggacttggacaaaccagctgggaaacacctgt
atataacaaaggcggcaacggcgtgtctgtagaagcacaaacaaaacaaaaggactctttgttaaatcattaccgtgaaatgattcgcgtgcgtc
agcagcacgaagagttagtaaaaggaacgcttcaatctatttcagtagacagtaaagaagtcgttgcctatagccgtacgtataaaggcaaatcg
attagcgtgtatcataatatttcaaatcaaccggtaaaagtatctgtagcagcaaaaggtaaattgattttttgctagtgaaaaaggtgctaagaaagt
caaaaatcagcttgtgattccggcgaatacaacggttttaataaaataa SEQ ID NO: 160
Met Gln Lys Lys Gly Asp Glu Thr Met Lys Gly Lys Lys Trp Thr Ala Leu Ala Leu Thr Leu Pro
Leu Ala Ala Ser Leu Ser Thr Gly Val His Ala Glu Thr Val His Lys Gly Lys Ser Pro Thr Ala Asp
Lys Asn Gly Val Phe Tyr Glu Val Tyr Val Asn Ser Phe Tyr Asp Ala Asn Lys Asp Gly His Gly Asp
Leu Lys Gly Leu Thr Gln Lys Leu Asp Tyr Leu Asn Asp Gly Asn Ser His Thr Lys Asn Asp Leu
Gln Val Asn Gly Ile Trp Met Met Pro Val Asn Pro Ser Pro Ser Tyr His Lys Tyr Asp Val Thr Asp
Tyr Tyr Asn Ile Asp Pro Gln Tyr Gly Asn Leu Gln Asp Phe Arg Lys Leu Met Lys Glu Ala Asp
Lys Arg Asp Val Lys Val Ile Met Asp Leu Val Val Asn His Thr Ser Ser Glu His Pro Trp Phe Gln
Ala Ala Leu Lys Asp Lys Asn Ser Lys Tyr Arg Asp Tyr Tyr Ile Trp Ala Asp Lys Asn Thr Asp Leu
Asn Glu Lys Gly Ser Trp Gly Gln Gln Val Trp His Lys Ala Pro Asn Gly Glu Tyr Phe Tyr Gly Thr

Figure 16OOO

Phe Trp Glu Gly Met Pro Asp Leu Asn Tyr Asp Asn Pro Glu Val Arg Lys Glu Met Ile Asn Val Gly
Lys Phe Trp Lys Gln Gly Val Asp Gly Phe Arg Leu Asp Ala Ala Leu His Ile Phe Lys Gly Gln
Thr Pro Glu Gly Ala Lys Lys Asn Leu Leu Trp Trp Asn Glu Phe Arg Asp Ala Met Lys Lys Glu
Asn Pro Asn Val Tyr Leu Thr Gly Glu Val Trp Asp Gln Pro Glu Val Val Ala Pro Tyr Tyr Gln Ser
Leu Asp Ser Leu Phe Asn Phe Asp Leu Ala Gly Lys Ile Val Asn Ser Val Lys Ser Gly Asn Asp Gln
Gly Ile Ala Thr Ala Ala Ala Ala Thr Asp Glu Leu Phe Lys Ser Tyr Asn Pro Asn Lys Ile Asp Gly
Ile Phe Leu Thr Asn His Asp Gln Asn Arg Val Met Ser Glu Leu Asn Gly Asp Val Asn Lys Ala Lys
Ser Ala Ala Ser Ile Leu Leu Thr Leu Pro Gly Asn Pro Tyr Ile Tyr Tyr Gly Glu Glu Ile Gly Met Thr
Gly Glu Lys Pro Asp Glu Leu Ile Arg Glu Pro Phe Pro Trp Tyr Glu Gly Asn Gly Leu Gly Gln Thr
Ser Trp Glu Thr Pro Val Tyr Asn Lys Gly Gly Asn Gly Val Ser Val Glu Ala Gln Thr Lys Gln Lys
Asp Ser Leu Leu Asn His Tyr Arg Glu Met Ile Arg Val Arg Gln Gln His Glu Glu Leu Val Lys Gly
Thr Leu Gln Ser Ile Ser Val Asp Ser Lys Glu Val Val Ala Tyr Ser Arg Thr Tyr Lys Gly Lys Ser Ile
Ser Val Tyr His Asn Ile Ser Asn Gln Pro Val Lys Val Ser Val Ala Ala Lys Gly Lys Leu Ile Phe Ala
Ser Glu Lys Gly Ala Lys Lys Val Lys Asn Gln Leu Val Ile Pro Ala Asn Thr Thr Val Leu Ile Lys

SEQ ID NO: 161
gtggatccaaagaattgtagtcaatttatgcaaacgattgcaaaaaaaggggatgaaacgatgaaagggaaaaaatggacagctttagctctaa
cactgccgctggctgctagcttatcaacaggtgttcacgccgaaaccgtacataaaggtaaagctccaacagcagataaaaacggtgtcttttat
gaggtatatgtaaactcttttacgatgcaaataaagatggacatggtgatttaaaaggccttacacaaaagttggactatttaaatgacggaaattc
tcatacaaagaatgatcttcaagtaaacgggatttggatgatgccggtcaacccttctcctagctatcataaatatgatgtaacggactattataatat
tgatccgcagtatggaaatctgcaagattttcgcaaacttatgaaagaagcagataaacgagacgtaaaagtcattatggaccttgttgtgaatcat
acgagcagtgaacaccccttggtttcaagctgcgttgaaagataaaaacagcaagtacagagattactatatttgggctgataaaaatactgacttg
aatgaaaaaggatcttgggggacaacaagtatggcataaagctccaaacggagagtattttacggaacgttctgggaaggaatgcctgacttaa
attacgataaccctgaagtaagaaaagaaatgattaacgtcggaaagttttggctaaaacaaggcgttgacggcttccgcttagatgctgcccttc
atattttaaaggtcaaacgcctgaaggcgctaagaaaaacattctatggtggaatgagtttagagatgcgatgaaaaaagaaaacccgaacgta
tatctaacgggtgaagtgtgggaccagccagaagtagtagccccttactatcaatcacttgattctctatttaattttgatttagcaggaaaaattgtc
agctctgtaaaagcaggaaatgatcaaggaatcgccactgcagcagcggcaactgatgagctgttcaaatcatacaatccaaataaaattgacg
gcattttcttaaccaaccatgaccaaaatcgcgtcatgagtgagttaagcggcgatgtgaataaagcaaaatcagccgcctctatcttacttacgct
tcctggaaatccgtatatttattacggtgaagaaattggcatgacaggtgaaaagcctgatgaattaatccgtgaaccgttccgctggtacgaagg
caacggaattggacaaactagctgggaaacacctgtatataacaaaggcggtaacggcgtgtctgtagaagcacaaacaaaacaaaaggatt
ccttgttaaatcattaccgtgaaatgattcgtgtgcgccagcagcacgaagagttagtaaaaggaacgcttcaatccatttcagtagacagtaaag
aagtcgttgcctatagccgcacgtacaaaggcaaatcgattagcgtgtatcataatatttcaaatcaacctgtaaaagtatctgtagcagcgaaag
gtaacttgattttgctagtgaaaaaggtgctaagaaagtcaaaaatcagcttgtgattccggcgaatgcgacggttttaataaaataa SEQ ID NO: 162
Val Asp Pro Lys Asn Cys Ser Gln Phe Met Gln Thr Ile Ala Lys Lys Gly Asp Glu Thr Met Lys Gly
Lys Lys Trp Thr Ala Leu Ala Leu Thr Leu Pro Leu Ala Ala Ser Leu Ser Thr Gly Val His Ala Glu
Thr Val His Lys Gly Lys Ala Pro Thr Ala Asp Lys Asn Gly Val Phe Tyr Glu Val Tyr Val Asn Ser
Phe Tyr Asp Ala Asn Lys Asp Gly His Gly Asp Leu Lys Gly Leu Thr Gln Lys Leu Asp Tyr Leu
Asn Asp Gly Asn Ser His Thr Lys Asn Asp Leu Gln Val Asn Gly Ile Trp Met Met Pro Val Asn Pro
Ser Pro Ser Tyr His Lys Tyr Asp Val Thr Asp Tyr Tyr Asn Ile Asp Pro Gln Tyr Gly Asn Leu Gln
Asp Phe Arg Lys Leu Met Lys Glu Ala Asp Lys Arg Asp Val Lys Val Ile Met Asp Leu Val Val
Asn His Thr Ser Ser Glu His Pro Trp Phe Gln Ala Ala Leu Lys Asp Lys Asn Ser Lys Tyr Arg Asp
Tyr Tyr Ile Trp Ala Asp Lys Asn Thr Asp Leu Asn Glu Lys Gly Ser Trp Gly Gln Gln Val Trp His
Lys Ala Pro Asn Gly Glu Tyr Phe Tyr Gly Thr Phe Trp Glu Gly Met Pro Asp Leu Asn Tyr Asp
Asn Pro Glu Val Arg Lys Glu Met Ile Asn Val Gly Lys Phe Trp Leu Lys Gln Gly Val Asp Gly Phe
Arg Leu Asp Ala Ala Leu His Ile Phe Lys Gly Gln Thr Pro Glu Gly Ala Lys Lys Asn Ile Leu Trp
Trp Asn Glu Phe Arg Asp Ala Met Lys Lys Glu Asn Pro Asn Val Tyr Leu Thr Gly Glu Val Trp
Asp Gln Pro Glu Val Val Ala Pro Tyr Tyr Gln Ser Leu Asp Ser Leu Phe Asn Phe Asp Leu Ala Gly
Lys Ile Val Ser Ser Val Lys Ala Gly Asn Asp Gln Gly Ile Ala Thr Ala Ala Ala Ala Thr Asp Glu

Figure 16PPP

Leu Phe Lys Ser Tyr Asn Pro Asn Lys Ile Asp Gly Ile Phe Leu Thr Asn His Asp Gln Asn Arg Val
Met Ser Glu Leu Ser Gly Asp Val Asn Lys Ala Lys Ser Ala Ala Ser Ile Leu Leu Thr Leu Pro Gly
Asn Pro Tyr Ile Tyr Tyr Gly Glu Glu Ile Gly Met Thr Gly Glu Lys Pro Asp Glu Leu Ile Arg Glu
Pro Phe Arg Trp Tyr Glu Gly Asn Gly Ile Gly Gln Thr Ser Trp Glu Thr Pro Val Tyr Asn Lys Gly
Gly Asn Gly Val Ser Val Glu Ala Gln Thr Lys Gln Lys Asp Ser Leu Leu Asn His Tyr Arg Glu Met
Ile Arg Val Arg Gln Gln His Glu Glu Leu Val Lys Gly Thr Leu Gln Ser Ile Ser Val Asp Ser Lys
Glu Val Val Ala Tyr Ser Arg Thr Tyr Lys Gly Lys Ser Ile Ser Val Tyr His Asn Ile Ser Asn Gln Pro
Val Lys Val Ser Val Ala Ala Lys Gly Asn Leu Ile Phe Ala Ser Glu Lys Gly Ala Lys Lys Val Lys
Asn Gln Leu Val Ile Pro Ala Asn Ala Thr Val Leu Ile Lys

SEQ ID NO: 163
atggtacgtcccgaacgacgggctgcattggaaccgactatcgaacgactcgcagcacttgaaagacattgggtgacgacggtgtggattccg
ccggcgtacaaaggcacgtcacagaacgatgtcgggtatggggcgtacgatttatacgatctcggcgaattcaaccaaaaaggacgacccg
gacgaagtacgggacgaaagcgcagctccagaccgccatctcgaacttgcgcggtaaagggatcggtgtgtacggcgacgtcgtcatgaat
cacaagggcggggccgattataccgaatccgttcaggcgatcgaggtcaatccgtcgaaccggaaccaagaaacgtccggtgagtatggcat
ctcggcctggactgggttcaacttcgcggggcgcaacaatacatactcgccgttcaaatggcgctggtaccattttgacggtaccgattgggatc
agtcacgcagcttgagccgcatctataagttcaagagcacaggcaaggcgtgggacacggacgtgtcgaacgagaacggcaactatgattat
cttatgtatgccgacgtcgatttcgagcatcccgaggtccgccaagagatgaagaactgggcaaatggtacgccgactcgctcgggctcgac
ggtttccggttggatgcggtcaaacatatcagccactcgtacttgaaggagtgggtgacgagcgtgcgccagacgaccgggaaagagatgttc
acggtcgccgagtattggaagaacgatctcggtgccatcaacgactatctgtataagacgggctacacgcactccgtcttcgatgtgccgctcc
attataacttccaagcggccggtaacggcggcgggtattacgatatgcgcaacatcttgaaaggcaccgtcaccgaacagcatccgtcgctgtc
cgtgacgattgtcgataaccacgactcacagccgggccagtcgctcgagtcgacggtcgccaactggttcaaaccgctcgcctacgcgacga
tcatgacgcgcggtcagggttatccggcccctcttctatggagactattatggcacgaaagggacgacgaaccgcgaaatcccgaacatgtcgg
gcacgctccaaccgattttgaaggcacgaaaagacttcgcctacgggacgcagcatgactacctcgatcatcaggacgtcatcggctggacac
gtgaaggtgtgaccgaccgtgccaaatcgggtctcgcgacgattctatcggacggtccgggcggctcgaagtggatgtacgtcggcaaacag
aacgccggcgaggtatggaaagacatgacgaacaacaacgcccgtctcgtcacgatcaatgctgacggctggggtcagttcttcgtcaacgg
aggctcggtctcgatttatacgcaacaataa SEQ ID NO: 164
Met Val Arg Pro Glu Arg Arg Ala Ala Leu Glu Pro Thr Ile Glu Arg Leu Ala Ala Leu Glu Arg His
Trp Val Thr Thr Val Trp Ile Pro Pro Ala Tyr Lys Gly Thr Ser Gln Asn Asp Val Gly Tyr Gly Ala
Tyr Asp Leu Tyr Asp Leu Gly Glu Phe Asn Gln Lys Gly Thr Thr Arg Thr Lys Tyr Gly Thr Lys
Ala Gln Leu Gln Thr Ala Ile Ser Asn Leu Arg Gly Lys Gly Ile Gly Val Tyr Gly Asp Val Val Met
Asn His Lys Gly Gly Ala Asp Tyr Thr Glu Ser Val Gln Ala Ile Glu Val Asn Pro Ser Asn Arg Asn
Gln Glu Thr Ser Gly Glu Tyr Gly Ile Ser Ala Trp Thr Gly Phe Asn Phe Ala Gly Arg Asn Asn Thr
Tyr Ser Pro Phe Lys Trp Arg Trp Tyr His Phe Asp Gly Thr Asp Trp Asp Gln Ser Arg Ser Leu Ser
Arg Ile Tyr Lys Phe Lys Ser Thr Gly Lys Ala Trp Asp Thr Asp Val Ser Asn Glu Asn Gly Asn Tyr
Asp Tyr Leu Met Tyr Ala Asp Val Asp Phe Glu His Pro Glu Val Arg Gln Glu Met Lys Asn Trp
Gly Lys Trp Tyr Ala Asp Ser Leu Gly Leu Asp Gly Phe Arg Leu Asp Ala Val Lys His Ile Ser His
Ser Tyr Leu Lys Glu Trp Val Thr Ser Val Arg Gln Thr Thr Gly Lys Glu Met Phe Thr Val Ala Glu
Tyr Trp Lys Asn Asp Leu Gly Ala Ile Asn Asp Tyr Leu Tyr Lys Thr Gly Tyr Thr His Ser Val Phe
Asp Val Pro Leu His Tyr Asn Phe Gln Ala Ala Gly Asn Gly Gly Gly Tyr Tyr Asp Met Arg Asn Ile
Leu Lys Gly Thr Val Thr Glu Gln His Pro Ser Leu Ser Val Thr Ile Val Asp Asn His Asp Ser Gln
Pro Gly Gln Ser Leu Glu Ser Thr Val Ala Asn Trp Phe Lys Pro Leu Ala Tyr Ala Thr Ile Met Thr
Arg Gly Gln Gly Tyr Pro Ala Leu Phe Tyr Gly Asp Tyr Tyr Gly Thr Lys Gly Thr Thr Asn Arg Glu
Ile Pro Asn Met Ser Gly Thr Leu Gln Pro Ile Leu Lys Ala Arg Lys Asp Phe Ala Tyr Gly Thr Gln
His Asp Tyr Leu Asp His Gln Asp Val Ile Gly Trp Thr Arg Glu Gly Val Thr Asp Arg Ala Lys Ser
Gly Leu Ala Thr Ile Leu Ser Asp Gly Pro Gly Gly Ser Lys Trp Met Tyr Val Gly Lys Gln Asn Ala
Gly Glu Val Trp Lys Asp Met Thr Asn Asn Asn Ala Arg Leu Val Thr Ile Asn Ala Asp Gly Trp Gly
Gln Phe Phe Val Asn Gly Gly Ser Val Ser Ile Tyr Thr Gln Gln

Figure 16QQQ

SEQ ID NO: 165
atgcagtatttcgagtggtacgtgccaaatgatggggaacattggaatcgtttgcgtaatgatgctgaaaatttagctcataaaggaattacatctgt
atggataccacccgtatataaaggaacttcacaaaatgatgtagggtatggagtgtatgatgtatatgatttgggagaattcaatcaaaaaggaac
gatacggacaaaatatgggacaaaagcacaattaaaatctgcaattgaggctttacataatcaaaatatcgatgtatacggtgatgttgttatgaac
cataaaggtggggcagattatactgaggttgtaacagccgttgaggtagaccgtaacaatcgaaatattgaaacatcgagtgattatcaaatagat
gcgtggacgggatttgattttccaggacgcagggactcctattctaattttaaatggagatggtttcattttgatggaacagattgggatgagggaa
ggaaattaaatagaattataaatttaaaggcgtaggtaaagcttgggactgggaagtgtctagtgagaatggtaactatgattatttaatgtatgca
gatcttgatttcgatcatcctgaagttgcaaatgaatgaaaaactggggaacctggtatgcggacgaattaaatttagatggctttcgtttagacg
cagttaaacatattgaccatgagtatcttcgtgattgggtaaatcatgttagaaagcaaacggggaaggaaatgtttacagtagctgaatattggca
aaatgatattcgtactttaaacaattatttagggaaagtaaattataatcaatctgtgttcgatgcacctcttcattataattttcattatgcttcaacagg
gaatggaaattatgatatgaggaatattttaaagggtacggtagtagaaagtcatcctacacttgctgttactcttgttgagaatcatgattctcagcc
tggacagtcattagaatctgttgtgagtccttggtttaagccgttggcctatgcatttattttaacgcgtgcagaagggtatccttctgttttttatggag
attactatggcacaaatggaaatagtagttatgaaattccaacgttaaaggataaaattgatccaattctgacggcacgaaaaaactttgcatatgg
tacgcaacatgattatttagaccatccagatgtgattggctggacaagagaaggggatagtatacatgctaattctggtttagcaacattaatctctg
atggaccaggaggatcaaaatggatgaatgttggaaagaacaacgcaggggaaatatggtacgatattacgggcaatcaaacaaatactgtaa
cgattaataaagatggatgggggcagttccatgtaaatgggggctctgtttcaatatatgttcagaagtaa SEQ ID NO: 166
Met Gln Tyr Phe Glu Trp Tyr Val Pro Asn Asp Gly Glu His Trp Asn Arg Leu Arg Asn Asp Ala
Glu Asn Leu Ala His Lys Gly Ile Thr Ser Val Trp Ile Pro Pro Val Tyr Lys Gly Thr Ser Gln Asn
Asp Val Gly Tyr Gly Val Tyr Asp Val Tyr Asp Leu Gly Glu Phe Asn Gln Lys Gly Thr Ile Arg Thr
Lys Tyr Gly Thr Lys Ala Gln Leu Lys Ser Ala Ile Glu Ala Leu His Asn Gln Asn Ile Asp Val Tyr
Gly Asp Val Val Met Asn His Lys Gly Gly Ala Asp Tyr Thr Glu Val Val Thr Ala Val Glu Val Asp
Arg Asn Asn Arg Asn Ile Glu Thr Ser Ser Asp Tyr Gln Ile Asp Ala Trp Thr Gly Phe Asp Phe Pro
Gly Arg Arg Asp Ser Tyr Ser Asn Phe Lys Trp Arg Trp Phe His Phe Asp Gly Thr Asp Trp Asp Glu
Gly Arg Lys Leu Asn Arg Ile Tyr Lys Phe Lys Gly Val Gly Lys Ala Trp Asp Trp Glu Val Ser Ser
Glu Asn Gly Asn Tyr Asp Tyr Leu Met Tyr Ala Asp Leu Asp Phe Asp His Pro Glu Val Ala Asn
Glu Met Lys Asn Trp Gly Thr Trp Tyr Ala Asp Glu Leu Asn Leu Asp Gly Phe Arg Leu Asp Ala
Val Lys His Ile Asp His Glu Tyr Leu Arg Asp Trp Val Asn His Val Arg Lys Gln Thr Gly Lys Glu
Met Phe Thr Val Ala Glu Tyr Trp Gln Asn Asp Ile Arg Thr Leu Asn Asn Tyr Leu Gly Lys Val Asn
Tyr Asn Gln Ser Val Phe Asp Ala Pro Leu His Tyr Asn Phe His Tyr Ala Ser Thr Gly Asn Gly Asn
Tyr Asp Met Arg Asn Ile Leu Lys Gly Thr Val Val Glu Ser His Pro Thr Leu Ala Val Thr Leu Val
Glu Asn His Asp Ser Gln Pro Gly Gln Ser Leu Glu Ser Val Val Ser Pro Trp Phe Lys Pro Leu Ala
Tyr Ala Phe Ile Leu Thr Arg Ala Glu Gly Tyr Pro Ser Val Phe Tyr Gly Asp Tyr Tyr Gly Thr Asn
Gly Asn Ser Ser Tyr Glu Ile Pro Thr Leu Lys Asp Lys Ile Asp Pro Ile Leu Thr Ala Arg Lys Asn
Phe Ala Tyr Gly Thr Gln His Asp Tyr Leu Asp His Pro Asp Val Ile Gly Trp Thr Arg Glu Gly Asp
Ser Ile His Ala Asn Ser Gly Leu Ala Thr Leu Ile Ser Asp Gly Pro Gly Gly Ser Lys Trp Met Asn
Val Gly Lys Asn Asn Ala Gly Glu Ile Trp Tyr Asp Ile Thr Gly Asn Gln Thr Asn Thr Val Thr Ile
Asn Lys Asp Gly Trp Gly Gln Phe His Val Asn Gly Gly Ser Val Ser Ile Tyr Val Gln Lys SEQ ID NO: 167
atgcaaacgattgcaaaaaaaggggatgaaacgatgaaagggaaaaaatggacagctttagctctaacactgccgctggctgctagcttatca
acaggcgttcacgccgaaaccgtacataaaggtaaatctccaacagcagataaaaaacggtgtatttatgaggtgtatgtaaactcttttacgatg
caaataaagatggacatggtgatttaaaaggtcttacacaaaagttggattatttaaatgatggcaattctcatacaaagaatgatcttcaagtaaac
gggatttggatgatgccggtcaaccccttctcccagctatcataaatatgatgtaacggactattataatattgatccgcagtatggaaatctgcaag
atttcgcaaaactgatgaaagaagcagataaacgagatgtaaaagtcattatggacctcgttgtgaatcatacgagcagtgaacacccttggtttc
aagctgcattaaaagataaaaacagcaagtacagagattactatatctgggctgataaaaataccgacttgaatgaaaaaggatcttggggaca
gcaagtatggcataaagccccaaacggagagtattttacggaacgtttgggaaggaatgccggacttaaattacgataatcctgaagtaagaa
aagaaatgattaacgtaggaaagttttggctaaagcaaggagttgacgggttccgtctagatgctgcgcttcatattttaaaggccaaacacctg aaggcgctaagaaaaatctcctgtggtggaatgaatttagagatgcaatgaaaaaggaaaaccctaacgtatatctaacgggtgaagtatggga
tcaaccggaagtagtagctccttactatcaatcgcttgattctttatttaactttgatttagcaggaaagattgtaaactctgtaaaatcaggaaatgat
caaggaatcgcgactgcagcagcggcaacggatgaactgttcaaatcatacaatccaaataaaattgacggtattttcttaaccaaccatgacca
aaatcgcgtcatgagtgagctaagcggcgatgtgaataaagcaaagtcagctgcctctatcttacttacgcttcctggcaacccgtatatttattac
ggtgaagaaatcggcatgaccggtgaaaagcctgatgagttaatccgtgaaccgttccgctggtacgaaggaaacggacttggacaaaccag
ctgggaaacacctgtatacaacaaaggcggcaacggcgtgtctgtagaagcacaaacaaaacaaaaggactctttgttaaatcattaccgtgaa
atgattcgcgtgcgtcagcagcacgaagagttagtaaaaggaacgcttcaatctatttcagtagacagtaaagaagtcgttgcctatagccgcac
gtataaaggcaaatcgattagcgtgtatcataatatttcaaatcaaccggtaaaagtatctgtagcagcaaaaggtaaattgattttggtagtgaaa
aaggtgctaagaaagtcaaaaatcagcttgtgattccggcgaatacaacggttttaataaaataa SEQ ID NO: 168
Met Gln Thr Ile Ala Lys Lys Gly Asp Glu Thr Met Lys Gly Lys Lys Trp Thr Ala Leu Ala Leu Thr
Leu Pro Leu Ala Ala Ser Leu Ser Thr Gly Val His Ala Glu Thr Val His Lys Gly Lys Ser Pro Thr
Ala Asp Lys Asn Gly Val Phe Tyr Glu Val Tyr Val Asn Ser Phe Tyr Asp Ala Asn Lys Asp Gly His
Gly Asp Leu Lys Gly Leu Thr Gln Lys Leu Asp Tyr Leu Asn Asp Gly Asn Ser His Thr Lys Asn
Asp Leu Gln Val Asn Gly Ile Trp Met Met Pro Val Asn Pro Ser Pro Ser Tyr His Lys Tyr Asp Val
Thr Asp Tyr Tyr Asn Ile Asp Pro Gln Tyr Gly Asn Leu Gln Asp Phe Arg Lys Leu Met Lys Glu Ala
Asp Lys Arg Asp Val Lys Val Ile Met Asp Leu Val Val Asn His Thr Ser Ser Glu His Pro Trp Phe
Gln Ala Ala Leu Lys Asp Lys Asn Ser Lys Tyr Arg Asp Tyr Tyr Ile Trp Ala Asp Lys Asn Thr Asp
Leu Asn Glu Lys Gly Ser Trp Gly Gln Gln Val Trp His Lys Ala Pro Asn Gly Glu Tyr Phe Tyr Gly
Thr Phe Trp Glu Gly Met Pro Asp Leu Asn Tyr Asp Asn Pro Glu Val Arg Lys Glu Met Ile Asn Val
Gly Lys Phe Trp Leu Lys Gln Gly Val Asp Gly Phe Arg Leu Asp Ala Ala Leu His Ile Phe Lys Gly
Gln Thr Pro Glu Gly Ala Lys Lys Asn Leu Leu Trp Trp Asn Glu Phe Arg Asp Ala Met Lys Lys
Glu Asn Pro Asn Val Tyr Leu Thr Gly Glu Val Trp Asp Gln Pro Glu Val Val Ala Pro Tyr Tyr Gln
Ser Leu Asp Ser Leu Phe Asn Phe Asp Leu Ala Gly Lys Ile Val Asn Ser Val Lys Ser Gly Asn Asp
Gln Gly Ile Ala Thr Ala Ala Ala Ala Thr Asp Glu Leu Phe Lys Ser Tyr Asn Pro Asn Lys Ile Asp
Gly Ile Phe Leu Thr Asn His Asp Gln Asn Arg Val Met Ser Glu Leu Ser Gly Asp Val Asn Lys Ala
Lys Ser Ala Ala Ser Ile Leu Leu Thr Leu Pro Gly Asn Pro Tyr Ile Tyr Tyr Gly Glu Glu Ile Gly Met
Thr Gly Glu Lys Pro Asp Glu Leu Ile Arg Glu Pro Phe Arg Trp Tyr Glu Gly Asn Gly Leu Gly Gln
Thr Ser Trp Glu Thr Pro Val Tyr Asn Lys Gly Gly Asn Gly Val Ser Val Glu Ala Gln Thr Lys Gln
Lys Asp Ser Leu Leu Asn His Tyr Arg Glu Met Ile Arg Val Arg Gln Gln His Glu Glu Leu Val Lys
Gly Thr Leu Gln Ser Ile Ser Val Asp Ser Lys Glu Val Val Ala Tyr Ser Arg Thr Tyr Lys Gly Lys
Ser Ile Ser Val Tyr His Asn Ile Ser Asn Gln Pro Val Lys Val Ser Val Ala Ala Lys Gly Lys Leu Ile
Phe Gly Ser Glu Lys Gly Ala Lys Lys Val Lys Asn Gln Leu Val Ile Pro Ala Asn Thr Thr Val Leu
Ile Lys SEQ ID NO: 169
atgaaaacattcaaattaaaacgcactttttaccgctaaccttgctgctcagtgctcctgcctttgctgggcaaaatggcaccatgatgcagtattt
cattggtatgtacctaatgatggcgcattatggacgcaggttgaaagcaatgctccagcactcgctgaaaacggttttacagcgctctggctacc
gccagcttacaaaggcgcgggcggcagtaatgacgtcggttatggcgtctatgatatgtacgatttaggtgagtttgatcaaaaaggctcagtac
gaaccaaatacggcaccaaggctcagtacatctctgcaatcaatgccgcgcacaacaacaatatccaaatctacggcgatgttgtgtttaaccac
cgaggtggtgctgatgggaagtcgtgggtcgataccaagcgcgttgattgggacaaccgtaacattgaactgggcgacaaatggattgaagct
tgggttgagtttaattttcctggccgcaacgacaaatactcaaacttccattggacttggtatcactttgacggtgttgactgggatgatgccggcaa
agaaaaagcgatctttaaattcaaaggcgaaggaaaagcatgggattgggaagtcagctctgaaaaaggcaattacgactacctaatgtacgc
cgatttagacatggatcaccaagaagttaaacaagagctgaaagattgggtgagtggtacatcaacatgaccggcgttgatggctttagaatg
gatgccgtgaagcacattaaatatcagtatctacaagagtggattgatcatttacgttggaaaacaggcaaagagcttttcaccgttggtgagtatt
ggaattacgacgtaaatcaactgcataacttttattactaagacctctggcagtatgtcgttgttcgatgcgccgcttcacatgaacttctacaacgcg
tcaaaatctggcggcaattacgatatgcgccaaatcatgaatggcacgttgatgaaggacaacccagtcaaagctgtgactctcgtagaaaacc
acgatacacagccattgcaggcgttagagtcgacagtggattggtggttcaagcctcttgcttacgcattcattttattgcgtgaagaaggttatcc
atcagtgttctacgcagattactacggcgcgcagtacagcgacaaaggctacaacatcaatatggccaaagttccttacattgaagaacttgtaa

Figure 16SSS cactgcgtaaagagtatgcgtatggcaaacagaattcttatctcgaccactgggatgtgattggctggacccgagagggcgatgctgaacatcc
aaactcaatggcggtgatcatgagtgatggaccaggtggcaaaaaatggatgtataccggtaagccaagcacgcgctatgtcgacaagctgg
gtatccgaactgaagaagtttggaccgataccaatggctgggcagaatttcctgtcaatggtggttcagtctcggtttgggtgggcgttaagtaa SEQ ID NO: 170
Met Lys Thr Phe Lys Leu Lys Arg Thr Phe Leu Pro Leu Thr Leu Leu Leu Ser Ala Pro Ala Phe Ala
Gly Gln Asn Gly Thr Met Met Gln Tyr Phe His Trp Tyr Val Pro Asn Asp Gly Ala Leu Trp Thr Gln
Val Glu Ser Asn Ala Pro Ala Leu Ala Glu Asn Gly Phe Thr Ala Leu Trp Leu Pro Pro Ala Tyr Lys
Gly Ala Gly Gly Ser Asn Asp Val Gly Tyr Gly Val Tyr Asp Met Tyr Asp Leu Gly Glu Phe Asp
Gln Lys Gly Ser Val Arg Thr Lys Tyr Gly Thr Lys Ala Gln Tyr Ile Ser Ala Ile Asn Ala Ala His
Asn Asn Asn Ile Gln Ile Tyr Gly Asp Val Val Phe Asn His Arg Gly Gly Ala Asp Gly Lys Ser Trp
Val Asp Thr Lys Arg Val Asp Trp Asp Asn Arg Asn Ile Glu Leu Gly Asp Lys Trp Ile Glu Ala Trp
Val Glu Phe Asn Phe Pro Gly Arg Asn Asp Lys Tyr Ser Asn Phe His Trp Thr Trp Tyr His Phe Asp
Gly Val Asp Trp Asp Asp Ala Gly Lys Glu Lys Ala Ile Phe Lys Phe Lys Gly Glu Gly Lys Ala Trp
Asp Trp Glu Val Ser Ser Glu Lys Gly Asn Tyr Asp Tyr Leu Met Tyr Ala Asp Leu Asp Met Asp
His Gln Glu Val Lys Gln Glu Leu Lys Asp Trp Gly Glu Trp Tyr Ile Asn Met Thr Gly Val Asp Gly
Phe Arg Met Asp Ala Val Lys His Ile Lys Tyr Gln Tyr Leu Gln Glu Trp Ile Asp His Leu Arg Trp
Lys Thr Gly Lys Glu Leu Phe Thr Val Gly Glu Tyr Trp Asn Tyr Asp Val Asn Gln Leu His Asn
Phe Ile Thr Lys Thr Ser Gly Ser Met Ser Leu Phe Asp Ala Pro Leu His Met Asn Phe Tyr Asn Ala
Ser Lys Ser Gly Gly Asn Tyr Asp Met Arg Gln Ile Met Asn Gly Thr Leu Met Lys Asp Asn Pro Val
Lys Ala Val Thr Leu Val Glu Asn His Asp Thr Gln Pro Leu Gln Ala Leu Glu Ser Thr Val Asp Trp
Trp Phe Lys Pro Leu Ala Tyr Ala Phe Ile Leu Leu Arg Glu Glu Gly Tyr Pro Ser Val Phe Tyr Ala
Asp Tyr Tyr Gly Ala Gln Tyr Ser Asp Lys Gly Tyr Asn Ile Asn Met Ala Lys Val Pro Tyr Ile Glu
Glu Leu Val Thr Leu Arg Lys Glu Tyr Ala Tyr Gly Lys Gln Asn Ser Tyr Leu Asp His Trp Asp Val
Ile Gly Trp Thr Arg Glu Gly Asp Ala Glu His Pro Asn Ser Met Ala Val Ile Met Ser Asp Gly Pro
Gly Gly Lys Lys Trp Met Tyr Thr Gly Lys Pro Ser Thr Arg Tyr Val Asp Lys Leu Gly Ile Arg Thr
Glu Glu Val Trp Thr Asp Thr Asn Gly Trp Ala Glu Phe Pro Val Asn Gly Gly Ser Val Ser Val Trp
Val Gly Val Lys SEQ ID NO: 171
gtgtatgtaaactcttttacgatgcaaataaagatggacatggtgatttaaaaggtcttacacaaaagttggattatttaaatgatggcaattctcata
caaagaatgatcttcaagtaaacgggatttggatgatgccggtcaacccttctcccagctatcataaatatgatgtaacggactattataatattgat
ccgcagtatggaaatctgcaagattttcgcaaactgatgaaagaagcagataaacgagatgtaaaagtcattatggacctcgttgtgaatcatac
gagcagtgaacacccttggtttcaagctgcattaaaagataaaaacagcaagtacagagattactatatctgggctgataaaaataccgacttga
atgaaaaaggatcttggggacagcaagtatggcataaagccccaaacggagagtattttacggaacgttttgggaaggaatgccggacttaaa
ttacgataatcctgaagtaagaaaagaaatgattaacgtaggaaagttttggctaaagcaaggagttgacggggtccgtctagatgctgcgcttca
tattttaaaggccaaacacctgaaggcgctaagaaaaatctcctgtggtggaatgaatttagagatgcaatgaaaaaggaaaaccctaacgtat
atctaacggggtgaagtatgggatcaaccggaagtagtagctccttactatcaatcgcttgattctttatttaactttgatttagcaggaaagattgtaa
actctgtaaaatcaggaaatgatcaaggaatcgcgactgcagcagcggcaacggatgaactgttcaaatcatacaatccaaataaaattgacgg
tattttcttaaccaaccatgaccaaaatcgcgtcatgagtgagctaagcggcgatgtgaataaagcaaagtcagctgcctctatcttacttacgctt
cctggcaacccgtatatttattacggtgaagaaatcggcatgaccggtgaaaagcctgatgagttaatccgtgaaccgttccgctggtacgaagg
aaaacggacttggacaaaccagctgggaaacacctgtatacaacaaaggcggcaacggcgtgtctgtagaagcacaaacaaaacaaaaggac
tctttgttaaatcattaccgtgaaatgattcgcgtgcgtcagcagcacgaagagttagtaaaaggaacgcttcaatctatttcagtagacagtaaag
aagtcgttgcctatagccgcacgtataaaggcaaatcgattagcgtgtatcataatatttcaaatcaaccggtaaaagtatctgtagcagcaaaag
gtaaattgattttggtagtgaaaaaggtgctaagaaagtcaaaaatcagcttgtgattccggcgaatacaacggttttaataaaataa SEQ ID NO: 172
Val Tyr Val Asn Ser Phe Tyr Asp Ala Asn Lys Asp Gly His Gly Asp Leu Lys Gly Leu Thr Gln
Lys Leu Asp Tyr Leu Asn Asp Gly Asn Ser His Thr Lys Asn Asp Leu Gln Val Asn Gly Ile Trp
Met Met Pro Val Asn Pro Ser Pro Ser Tyr His Lys Tyr Asp Val Thr Asp Tyr Tyr Asn Ile Asp Pro

Figure 16TTT

Gln Tyr Gly Asn Leu Gln Asp Phe Arg Lys Leu Met Lys Glu Ala Asp Lys Arg Asp Val Lys Val
Ile Met Asp Leu Val Val Asn His Thr Ser Ser Glu His Pro Trp Phe Gln Ala Ala Leu Lys Asp Lys
Asn Ser Lys Tyr Arg Asp Tyr Tyr Ile Trp Ala Asp Lys Asn Thr Asp Leu Asn Glu Lys Gly Ser Trp
Gly Gln Gln Val Trp His Lys Ala Pro Asn Gly Glu Tyr Phe Tyr Gly Thr Phe Trp Glu Gly Met Pro
Asp Leu Asn Tyr Asp Asn Pro Glu Val Arg Lys Glu Met Ile Asn Val Gly Lys Phe Trp Leu Lys
Gln Gly Val Asp Gly Phe Arg Leu Asp Ala Ala Leu His Ile Phe Lys Gly Gln Thr Pro Glu Gly Ala
Lys Lys Asn Leu Leu Trp Trp Asn Glu Phe Arg Asp Ala Met Lys Lys Glu Asn Pro Asn Val Tyr
Leu Thr Gly Glu Val Trp Asp Gln Pro Glu Val Val Ala Pro Tyr Tyr Gln Ser Leu Asp Ser Leu Phe
Asn Phe Asp Leu Ala Gly Lys Ile Val Asn Ser Val Lys Ser Gly Asn Asp Gln Gly Ile Ala Thr Ala
Ala Ala Ala Thr Asp Glu Leu Phe Lys Ser Tyr Asn Pro Asn Lys Ile Asp Gly Ile Phe Leu Thr Asn
His Asp Gln Asn Arg Val Met Ser Glu Leu Ser Gly Asp Val Asn Lys Ala Lys Ser Ala Ala Ser Ile
Leu Leu Thr Leu Pro Gly Asn Pro Tyr Ile Tyr Tyr Gly Glu Glu Ile Gly Met Thr Gly Glu Lys Pro
Asp Glu Leu Ile Arg Glu Pro Phe Arg Trp Tyr Glu Gly Asn Gly Leu Gly Gln Thr Ser Trp Glu Thr
Pro Val Tyr Asn Lys Gly Gly Asn Gly Val Ser Val Glu Ala Gln Thr Lys Gln Lys Asp Ser Leu Leu
Asn His Tyr Arg Glu Met Ile Arg Val Arg Gln Gln His Glu Glu Leu Val Lys Gly Thr Leu Gln Ser
Ile Ser Val Asp Ser Lys Glu Val Val Ala Tyr Ser Arg Thr Tyr Lys Gly Lys Ser Ile Ser Val Tyr His
Asn Ile Ser Asn Gln Pro Val Lys Val Ser Val Ala Ala Lys Gly Lys Leu Ile Phe Gly Ser Glu Lys
Gly Ala Lys Lys Val Lys Asn Gln Leu Val Ile Pro Ala Asn Thr Thr Val Leu Ile Lys

SEQ ID NO: 173
atgcaaacgattgcaaaaaaggggatgaaacgatgaaagggaaaaaatggacagctttagctctaacactgccgctggctgctagcttatca
acaggcgttcacgcagaaactgtacataaaggtaaagctccaacagcagataaaaacggtgttttttatgaggtgtatgtaaactcttttacgatg
caaataaagatggacatggtgatttaaaaggtctgacacaaaagttggattatttaaatgacggcaattctcatacaaagaatgatcttcaagtaaa
cgggatttggatgatgccggtaaaacccttctcctagctatcataaatatgatgtaacggactattataacattgatcctcagtacggaagtctgcaa
gatttccgcaaactgatgaaagaagcagataaacgagacgtaaaagttattatggaccttgttgtgaatcatacgagcagtgaacacccttggttt
caagctgcactaaaagataaaaacagcaagtacagagattactatatttgggctgataaaaataccgatttgaatgaaaaaggatcttggggaca
gcaagtatggcataaagctccaaacggagagtattttacggaacgttctgggaaggaatgcctgacttaaattacgataaccctgaagtaagaa
aagaaatgattaacgtcggaaagttttggctaaagcaaggcgttgatggcttccgcttagatgctgcccttcatatcttaaaggtcaaactcctga
aggcgctaagaaaaatctcctgtggtggaatgagtttagagatgcaatgaaaaaagaaaaccctaacgtatatctaacgggtgaagtatgggat
cagccggaagtagtagctccttattatcaatcgcttgattccctatttaactttgatttagcaggaaaaattgtcagctctgtaaaagcaggaaatgat
caaggaatcgccactgcagcagcggcaacggatgagctgttcaaatcatacaatccaaataaaattgacggcatttctttaaccaaccatgacca
aaaccgcgtcatgagtgagctaagcggagatgtgaataaagcaaaatcagctgcttctatcttacttacgcttcctggaaatccgtatatttattacg
gtgaagaaattggcatgaccggtgaaaagcctgatgaattaatccgtgaaccgttccgctggtacgaaggcaacggaattggacaaactagct
gggaaaacacctgtatataacaaaggcggcaatggtgtgtctgtagaagcacaaaccaaacaaaaggattctttgttaaatcattaccgtgaaatg
attcgcgtgcgtcagcagcacgaagagttagtaaaaggaacgcttcagtctatttcagtagacagtaaagaagttgtcgcttatagccgtacgtat
aaaggcaactccattagtgtgtatcataatatttcaaatcaacctgtaaaagtatctgtagcggcgaaaggtaaattgattttttgctagtgaaaaagg
tgctaaaaaaggcaaaaatcagcttgtgattccggcgaatgcgacggttttaataaaataa SEQ ID NO: 174
Met Gln Thr Ile Ala Lys Lys Gly Asp Glu Thr Met Lys Gly Lys Lys Trp Thr Ala Leu Ala Leu Thr
Leu Pro Leu Ala Ala Ser Leu Ser Thr Gly Val His Ala Glu Thr Val His Lys Gly Lys Ala Pro Thr
Ala Asp Lys Asn Gly Val Phe Tyr Glu Val Tyr Val Asn Ser Phe Tyr Asp Ala Asn Lys Asp Gly His
Gly Asp Leu Lys Gly Leu Thr Gln Lys Leu Asp Tyr Leu Asn Asp Gly Asn Ser His Thr Lys Asn
Asp Leu Gln Val Asn Gly Ile Trp Met Met Pro Val Asn Pro Ser Pro Ser Tyr His Lys Tyr Asp Val
Thr Asp Tyr Tyr Asn Ile Asp Pro Gln Tyr Gly Ser Leu Gln Asp Phe Arg Lys Leu Met Lys Glu Ala
Asp Lys Arg Asp Val Lys Val Ile Met Asp Leu Val Val Asn His Thr Ser Ser Glu His Pro Trp Phe
Gln Ala Ala Leu Lys Asp Lys Asn Ser Lys Tyr Arg Asp Tyr Tyr Ile Trp Ala Asp Lys Asn Thr Asp
Leu Asn Glu Lys Gly Ser Trp Gly Gln Gln Val Trp His Lys Ala Pro Asn Gly Glu Tyr Phe Tyr Gly
Thr Phe Trp Glu Gly Met Pro Asp Leu Asn Tyr Asp Asn Pro Glu Val Arg Lys Glu Met Ile Asn Val
Gly Lys Phe Trp Leu Lys Gln Gly Val Asp Gly Phe Arg Leu Asp Ala Ala Leu His Ile Phe Lys Gly

Figure 16UUU

Gln Thr Pro Glu Gly Ala Lys Lys Asn Leu Leu Trp Trp Asn Glu Phe Arg Asp Ala Met Lys Lys
Glu Asn Pro Asn Val Tyr Leu Thr Gly Glu Val Trp Asp Gln Pro Glu Val Val Ala Pro Tyr Tyr Gln
Ser Leu Asp Ser Leu Phe Asn Phe Asp Leu Ala Gly Lys Ile Val Ser Ser Val Lys Ala Gly Asn Asp
Gln Gly Ile Ala Thr Ala Ala Ala Ala Thr Asp Glu Leu Phe Lys Ser Tyr Asn Pro Asn Lys Ile Asp
Gly Ile Phe Leu Thr Asn His Asp Gln Asn Arg Val Met Ser Glu Leu Ser Gly Asp Val Asn Lys Ala
Lys Ser Ala Ala Ser Ile Leu Leu Thr Leu Pro Gly Asn Pro Tyr Ile Tyr Tyr Gly Glu Glu Ile Gly Met
Thr Gly Glu Lys Pro Asp Glu Leu Ile Arg Glu Pro Phe Arg Trp Tyr Glu Gly Asn Gly Ile Gly Gln
Thr Ser Trp Glu Thr Pro Val Tyr Asn Lys Gly Gly Asn Gly Val Ser Val Glu Ala Gln Thr Lys Gln
Lys Asp Ser Leu Leu Asn His Tyr Arg Glu Met Ile Arg Val Arg Gln Gln His Glu Glu Leu Val Lys
Gly Thr Leu Gln Ser Ile Ser Val Asp Ser Lys Glu Val Val Ala Tyr Ser Arg Thr Tyr Lys Gly Asn
Ser Ile Ser Val Tyr His Asn Ile Ser Asn Gln Pro Val Lys Val Ser Val Ala Ala Lys Gly Lys Leu Ile
Phe Ala Ser Glu Lys Gly Ala Lys Lys Gly Lys Asn Gln Leu Val Ile Pro Ala Asn Ala Thr Val Leu
Ile Lys

SEQ ID NO: 175
atgaaaaatataatacgactttgtgctgccagcgctatcctcacggtgtcccacgccagttacgccgacgcaattttacacgcgtttaactggcaat
ataccgatgtaaccgccaatgcaaatcaaattgccgcaaatggctttaaaaaagtcctcatttcacccgcaatgaaatccagcggcagtcaatgg
tgggcccgctatcaaccgcaagacttgcgtgtcattgattctccgctgggcaacaaacaagatttagtcgcgatgatcaatgcgctcaacagcgt
tggggtcgacgtgtatgctgacgtggtgcttaaccatatggctaacgagtcatggaagcgcagtgacctgaactacccggggagtgaggtgct
caacgactatcaatcccgcagtgcttactatcaaaggcaaacacttttcggcaatttacaggagaaccttttttccgagaatgatttccatccggca
ggctgtattaccaattggaatgatcctggccacgtccagtattggcgcttgtgcggcggacagggcgatactgggctaccggatctcgatcctaa
tcaatgggttgtgagtcagcagaagagttacttgaacgcactcaaatcaatgggaatcaaaggggttccgtatcgatgcggtcaaacatatgagtc
aatatcaaatagaccaagtgtttaccccagacattaccgctggtatgcatatattcggagaagtcattaccagtggtgggcaaggtgatagcggct
atgaggcttttcttgccccttaccttaataataccgatcacgccgcttatgacttcccgctatttgcatcgattcgagccgcgttttcattctctggtgg
gttaaatcagctacacaatccacaagcctatggccaagcgttacaggactcacgtgcgatcacctttacgattacccacgacattccaaccaatg
acggtttccgctaccagatcatggatccaaccgatgaacagctcgcctatgcctacatcttgggcaaagatggaggaacgccacttgtctatagt
gatgacctacctgacagcgaagacaaagacagtggtcgttgggccgatgtgtggcaagatccgaacatgattaacatgcttgccttccacaacg
cgatgcaaggacaaagcatgactgtagtggctagcgatcaatgtaccttgctatttaagcgcggcaagcaaggcgtggtaggaatcaataaatg
tggcgagagtaagtcggtgactgtcgatacttaccagcatgagtttaactggtacaccccgtaccaagacgtattgagcggcgacatcaccaca
gtgagttctcgttatcaccaatttgttttgccagcgcgcagtgcaaggatgtggaaactataa SEQ ID NO: 176
Met Lys Asn Ile Ile Arg Leu Cys Ala Ala Ser Ala Ile Leu Thr Val Ser His Ala Ser Tyr Ala Asp Ala
Ile Leu His Ala Phe Asn Trp Gln Tyr Thr Asp Val Thr Ala Asn Ala Asn Gln Ile Ala Ala Asn Gly
Phe Lys Lys Val Leu Ile Ser Pro Ala Met Lys Ser Ser Gly Ser Gln Trp Trp Ala Arg Tyr Gln Pro
Gln Asp Leu Arg Val Ile Asp Ser Pro Leu Gly Asn Lys Gln Asp Leu Val Ala Met Ile Asn Ala Leu
Asn Ser Val Gly Val Asp Val Tyr Ala Asp Val Val Leu Asn His Met Ala Asn Glu Ser Trp Lys Arg
Ser Asp Leu Asn Tyr Pro Gly Ser Glu Val Leu Asn Asp Tyr Gln Ser Arg Ser Ala Tyr Tyr Gln Arg
Gln Thr Leu Phe Gly Asn Leu Gln Glu Asn Leu Phe Ser Glu Asn Asp Phe His Pro Ala Gly Cys Ile
Thr Asn Trp Asn Asp Pro Gly His Val Gln Tyr Trp Arg Leu Cys Gly Gly Gln Gly Asp Thr Gly
Leu Pro Asp Leu Asp Pro Asn Gln Trp Val Val Ser Gln Gln Lys Ser Tyr Leu Asn Ala Leu Lys Ser
Met Gly Ile Lys Gly Phe Arg Ile Asp Ala Val Lys His Met Ser Gln Tyr Gln Ile Asp Gln Val Phe
Thr Pro Asp Ile Thr Ala Gly Met His Ile Phe Gly Glu Val Ile Thr Ser Gly Gly Gln Gly Asp Ser Gly
Tyr Glu Ala Phe Leu Ala Pro Tyr Leu Asn Asn Thr Asp His Ala Ala Tyr Asp Phe Pro Leu Phe Ala
Ser Ile Arg Ala Ala Phe Ser Phe Ser Gly Gly Leu Asn Gln Leu His Asn Pro Gln Ala Tyr Gly Gln
Ala Leu Gln Asp Ser Arg Ala Ile Thr Phe Thr Ile Thr His Asp Ile Pro Thr Asn Asp Gly Phe Arg
Tyr Gln Ile Met Asp Pro Thr Asp Glu Gln Leu Ala Tyr Ala Tyr Ile Leu Gly Lys Asp Gly Gly Thr
Pro Leu Val Tyr Ser Asp Asp Leu Pro Asp Ser Glu Asp Lys Asp Ser Gly Arg Trp Ala Asp Val Trp
Gln Asp Pro Asn Met Ile Asn Met Leu Ala Phe His Asn Ala Met Gln Gly Gln Ser Met Thr Val Val
Ala Ser Asp Gln Cys Thr Leu Leu Phe Lys Arg Gly Lys Gln Gly Val Val Gly Ile Asn Lys Cys Gly

Figure 16VVV

Glu Ser Lys Ser Val Thr Val Asp Thr Tyr Gln His Glu Phe Asn Trp Tyr Thr Pro Tyr Gln Asp Val
Leu Ser Gly Asp Ile Thr Thr Val Ser Ser Arg Tyr His Gln Phe Val Leu Pro Ala Arg Ser Ala Arg
Met Trp Lys Leu

SEQ ID NO: 177
atgaaaacattcaaattaaaacgcacttttttaccgctgaccttgctgctcagtgctcctgcctttgctgggcaaaatggcaccatgatgcagtatttt
cattggtacgtacctaatgatggcgcattatggacgcaggttgaaagcaatgctccagtactcgctgaaaacggttttacagcgctctggctacc
gcccgcatacaaaggcgcgggcggcagtaatgacgtcggttatggcgtctatgatatgtacgatttaggtgagtttgaccaaaaaggctcagta
cgaaccaaatacggcaccaaggctcagtacatctctgcaatcaatgccgcgcacaacaacaatatccaaatttacggcgacgttgtgtttaacca
ccgaggtggcgctgatgggaagtcgtgggtcgataccaagcgcgttgattgggacaaccgcaatattgaactgggcgacaaatggattgaag
cttggggttgagtttaattttcctggccgcaacgacaaatactcgaacttccattggacttggtatcactttgacggtgttgactgggatgatgccggc
aaagaaaaagcgatctttaaattcaaaggcgaaggaaaagcatgggattgggaagtcagctctgaaaaaggcaattacgactacctaatgtac
gccgatttagacatggatcacccagaagttaaacaagagctgaaagattggggtgagtggtacatcaacatgaccggcgttgatggctttagaa
tggatgccgtgaagcacattaaatatcagtatctacaagagtggattgatcatttacgttggaaaacaggcaaagagcttttcaccgttggtgagta
ttggaattacgacgtaaatcaactgcacaactttattactaagacctctggcagtatgtcgttgttcgatgcgccgcttcacatgaatttctacaacgc
gtcaaaatctggcggcacttacgatatgcgccaaatcatgaatggcacgttgatgaaggacaacccagtcaaagcagtgactctcgtagaaaac
cacgatacgcagccattgcaggcgttagagtcgacagtagattggtggttcaagcctcttgcttacgcattcattttattgcgtgaagaaggttatc
catcggtgttctacgcagattactacggcgcgcagtacagcgacaaaggttacaacattaatatggccaaagtgccttacattgaagaacttgtaa
cactgcgtaaagagtatgcgtatggcaaacagaattcttatctcgaccattgggatgtgattggctggacccgagagggcgatgctgaacatcc
aaactcaatggcggtgatcatgagtgatggaccgggcggcacaaaatggatgtataccggtaagccaagtacgcgctatgtcgacaagctgg
gtatccgaactgaagatgtttggaccgatgccaatggctgggcagaattcctgtcaatggtggttcagtctcggtttgggtgggcgttaagtaa SEQ ID NO: 178
Met Lys Thr Phe Lys Leu Lys Arg Thr Phe Leu Pro Leu Thr Leu Leu Leu Ser Ala Pro Ala Phe Ala
Gly Gln Asn Gly Thr Met Met Gln Tyr Phe His Trp Tyr Val Pro Asn Asp Gly Ala Leu Trp Thr Gln
Val Glu Ser Asn Ala Pro Val Leu Ala Glu Asn Gly Phe Thr Ala Leu Trp Leu Pro Pro Ala Tyr Lys
Gly Ala Gly Gly Ser Asn Asp Val Gly Tyr Gly Val Tyr Asp Met Tyr Asp Leu Gly Glu Phe Asp
Gln Lys Gly Ser Val Arg Thr Lys Tyr Gly Thr Lys Ala Gln Tyr Ile Ser Ala Ile Asn Ala Ala His
Asn Asn Asn Ile Gln Ile Tyr Gly Asp Val Val Phe Asn His Arg Gly Gly Ala Asp Gly Lys Ser Trp
Val Asp Thr Lys Arg Val Asp Trp Asp Asn Arg Asn Ile Glu Leu Gly Asp Lys Trp Ile Glu Ala Trp
Val Glu Phe Asn Phe Pro Gly Arg Asn Asp Lys Tyr Ser Asn Phe His Trp Thr Trp Tyr His Phe Asp
Gly Val Asp Trp Asp Asp Ala Gly Lys Glu Lys Ala Ile Phe Lys Phe Lys Gly Glu Gly Lys Ala Trp
Asp Trp Glu Val Ser Ser Glu Lys Gly Asn Tyr Asp Tyr Leu Met Tyr Ala Asp Leu Asp Met Asp
His Pro Glu Val Lys Gln Glu Leu Lys Asp Trp Gly Glu Trp Tyr Ile Asn Met Thr Gly Val Asp Gly
Phe Arg Met Asp Ala Val Lys His Ile Lys Tyr Gln Tyr Leu Gln Glu Trp Ile Asp His Leu Arg Trp
Lys Thr Gly Lys Glu Leu Phe Thr Val Gly Glu Tyr Trp Asn Tyr Asp Val Asn Gln Leu His Asn
Phe Ile Thr Lys Thr Ser Gly Ser Met Ser Leu Phe Asp Ala Pro Leu His Met Asn Phe Tyr Asn Ala
Ser Lys Ser Gly Gly Thr Tyr Asp Met Arg Gln Ile Met Asn Gly Thr Leu Met Lys Asp Asn Pro Val
Lys Ala Val Thr Leu Val Glu Asn His Asp Thr Gln Pro Leu Gln Ala Leu Glu Ser Thr Val Asp Trp
Trp Phe Lys Pro Leu Ala Tyr Ala Phe Ile Leu Arg Glu Glu Gly Tyr Pro Ser Val Phe Tyr Ala
Asp Tyr Tyr Gly Ala Gln Tyr Ser Asp Lys Gly Tyr Asn Ile Asn Met Ala Lys Val Pro Tyr Ile Glu
Glu Leu Val Thr Leu Arg Lys Glu Tyr Ala Tyr Gly Lys Gln Asn Ser Tyr Leu Asp His Trp Asp Val
Ile Gly Trp Thr Arg Glu Gly Asp Ala Glu His Pro Asn Ser Met Ala Val Ile Met Ser Asp Gly Pro
Gly Gly Thr Lys Trp Met Tyr Thr Gly Lys Pro Ser Thr Arg Tyr Val Asp Lys Leu Gly Ile Arg Thr
Glu Asp Val Trp Thr Asp Ala Asn Gly Trp Ala Glu Phe Pro Val Asn Gly Gly Ser Val Ser Val Trp
Val Gly Val Lys SEQ ID NO: 179
atgaaaacattcaaattaaaacgcacttttttaccgctaaccttgctgctcagtgctcctgcctttgccgggcaaaatggcaccatgatgcagtactt
tcattggtacgtacctaatgatggcgcattatggacgcaggttgaaagcaatgctccagcactcgctgaaaacggttttacagcgctctggctacc

Figure 16WWW gccagcttacaaaggcgcgggcggcagtaatgatgtcggttatggcgtctacgatatgtacgatttaggtgagtttgatcaaaaaggctcagtac
gaaccaaatacggtaccaaggctcagtacatctctgcaatcaatgctgcgcacaacaacaatatccaaatttacggcgacgttgtgtttaaccatc
gtggtggcgctgatgggaagtcgtgggtcgataccaagcgcgttgattgggacaaccgtaacattgaactgggcgacaaatggattgaagctt
gggttgagtttaattttcctagccgcaacgacaaatactcgaacttccattggacttggtatcactttgacggtgttgactgggatgatgccggcaa
agaaaaagcgatctttaaattcaaaggcgaaggaaaagcatgggattgggaagtcagctctgaaaaaggcaattacgactacctaatgtacgc
cgatttagacatggatcacccagaagttaaacaagagctgaaagattgggggtgagtggtacatcaacatgaccggcgttgatggctttagaatg
gatgccgttaagcacattaaatatcagtatctacaagagtggattgatcatttacgttggaaaacaggcaaagagcttttcaccgttggtgagtattg
gaattacgacgtaaatcaactgcataactttattactaagaccctctggcagtatgtcgttgttcgatgcgccgcttcacatgaacttctacaacgcgt
caaaatctggcggcaattacgatatgcgccaaatcatgaatggcacgttgatgaaggacaacccagtcaaagctgtgactctcgtagaaaacca
cgatacgcagccattgcaggcgttagagtcgacagtggattggtggttcaagcctcttgcttacgcattcatcttgttgcgtgaagaaggttatcca
tcggtgttctacgcagattactacggcgcgcagtacagcgacaaaggttacaacattaatatggccaaagtgccttacattgaagaacttgtaaca
ctgcgtaaagagtatgcgtatggcaaacagaattcttatctcgaccattgggatgtgattggctggactcgagagggcgatgctgaacatccaaa
ctcaatggcggtgatcatgagtgatggaccgggcggaacaaaatggatgtataccggtaatccaagcacgcgctatgtcgacaagctgggtat
ccgaactgaagatgtttggaccgatgccaatggctgggcagaatttcctgtcaatggtggttcagtctcggtttgggtgggcgttaagtaa SEQ ID NO: 180
Met Lys Thr Phe Lys Leu Lys Arg Thr Phe Leu Pro Leu Thr Leu Leu Leu Ser Ala Pro Ala Phe Ala
Gly Gln Asn Gly Thr Met Met Gln Tyr Phe His Trp Tyr Val Pro Asn Asp Gly Ala Leu Trp Thr Gln
Val Glu Ser Asn Ala Pro Ala Leu Ala Glu Asn Gly Phe Thr Ala Leu Trp Leu Pro Pro Ala Tyr Lys
Gly Ala Gly Gly Ser Asn Asp Val Gly Tyr Gly Val Tyr Asp Met Tyr Asp Leu Gly Glu Phe Asp
Gln Lys Gly Ser Val Arg Thr Lys Tyr Gly Thr Lys Ala Gln Tyr Ile Ser Ala Ile Asn Ala Ala His
Asn Asn Asn Ile Gln Ile Tyr Gly Asp Val Val Phe Asn His Arg Gly Gly Ala Asp Gly Lys Ser Trp
Val Asp Thr Lys Arg Val Asp Trp Asp Asn Arg Asn Ile Glu Leu Gly Asp Lys Trp Ile Glu Ala Trp
Val Glu Phe Asn Phe Pro Ser Arg Asn Asp Lys Tyr Ser Asn Phe His Trp Thr Trp Tyr His Phe Asp
Gly Val Asp Trp Asp Asp Ala Gly Lys Glu Lys Ala Ile Phe Lys Phe Lys Gly Glu Gly Lys Ala Trp
Asp Trp Glu Val Ser Ser Glu Lys Gly Asn Tyr Asp Tyr Leu Met Tyr Ala Asp Leu Asp Met Asp
His Pro Glu Val Lys Gln Glu Leu Lys Asp Trp Gly Glu Trp Tyr Ile Asn Met Thr Gly Val Asp Gly
Phe Arg Met Asp Ala Val Lys His Ile Lys Tyr Gln Tyr Leu Gln Glu Trp Ile Asp His Leu Arg Trp
Lys Thr Gly Lys Glu Leu Phe Thr Val Gly Glu Tyr Trp Asn Tyr Asp Val Asn Gln Leu His Asn
Phe Ile Thr Lys Thr Ser Gly Ser Met Ser Leu Phe Asp Ala Pro Leu His Met Asn Phe Tyr Asn Ala
Ser Lys Ser Gly Gly Asn Tyr Asp Met Arg Gln Ile Met Asn Gly Thr Leu Met Lys Asp Asn Pro Val
Lys Ala Val Thr Leu Val Glu Asn His Asp Thr Gln Pro Leu Gln Ala Leu Glu Ser Thr Val Asp Trp
Trp Phe Lys Pro Leu Ala Tyr Ala Phe Ile Leu Leu Arg Glu Glu Gly Tyr Pro Ser Val Phe Tyr Ala
Asp Tyr Tyr Gly Ala Gln Tyr Ser Asp Lys Gly Tyr Asn Ile Asn Met Ala Lys Val Pro Tyr Ile Glu
Glu Leu Val Thr Leu Arg Lys Glu Tyr Ala Tyr Gly Lys Gln Asn Ser Tyr Leu Asp His Trp Asp Val
Ile Gly Trp Thr Arg Glu Gly Asp Ala Glu His Pro Asn Ser Met Ala Val Ile Met Ser Asp Gly Pro
Gly Gly Thr Lys Trp Met Tyr Thr Gly Asn Pro Ser Thr Arg Tyr Val Asp Lys Leu Gly Ile Arg Thr
Glu Asp Val Trp Thr Asp Ala Asn Gly Trp Ala Glu Phe Pro Val Asn Gly Gly Ser Val Ser Val Trp
Val Gly Val Lys SEQ ID NO: 181
ttgccagaggccttcggcctggccattacgccgtcacatagccggcggggaggttggtgggcgtgtcgcgcggggcagcctgccgatgc
cggtcctccactggccggcgttcatcctcgtccggcgcttcgtcgccggtcatccgaacaagcacaagaaccggagtattgcgatgagccaca
ccctgcgtgccgccgtattggcggcgatcctgctgccgttccccgccctcgctgaccaggccggcaagagcccggccggcgtgcgctacca
cggcggcgacgaaatcatcctccagggcttccactggaacgtcgtccgcgaagcgcccaacgactggtacaacatccttcgccagcaggcct
cgacgatcgccgcggacggcttctcggcaatctggatgccggtgccctggcgtgacttctccagctggaccgacggcggcaagtcaggcgg
cggcgaaggctacttctggcacgacttcaacaagaacggccgctacggcagcgacgcccagctgcgccaggccgccggcgcactcggtgg
cgccggggtgaaggtgctctacgatgtggtgcccaatcacatgaaccgcggctatccggacaaggagatcaacctgccggccggccagggc
ttctggcgcaacgactgcaccgacccgggcaactaccccaacgactgcgatgacggtgaccgcttcatcggcggcaagtcggacctgaaca
ccggccatccgcagatctacggcatgttcgcgacgagcttgccaacctgcgcagcgggtacggcgccggcggcttccgcttcgacttcgttc

Figure 16XXX gcggctatgcgcccgaacgggtcgacagctggatgagcgacugcgccgacagcagtttctgcgttggcgagctgtggaaaagcccgtccga
gtacccgagctgggactggcgcaacacggcgagctggcagcagatcatcaaggactggtccgaccgggccaagtgcccggtgttcgacttc
gcgctcaaggagcgcatgcagaacggctcggtcgccgactggaagcatggcctcaatggcaacccggacccgcgctggcgcgaggtggc
ggtgacctttgtcgacaaccacgacaccggctattcgcccgggcagaacggcggccagcaccactgggcgctgcaggacgggctgatccg
ccaggcctacgcctacatcctcaccagcccgggcacgccggtggtgtactggtcgcacatgtacgactggggctacggcgacttcattcgcca
gctgatccaggtgcggcgcaccgctggcgtgcgcgccgattcggcgatcagcttccacagcggctacagcggcctggtcgctaccgtcagc
ggcagccatcagaccctggtggtggcgctcaactccgatctggccaaccccggccaggtcgccagcggcagcttcagcgaggcggtcaac
gccagcaacggccaggtgcgcgtctggcgcagcggtagcggcgatggcggcggcaatgacggcggcgagggcggtctggtcaatgtgaa
cttccgctgcgacaacggcgtgacgcagatgggcgacagcgtctacgcggtgggcaacgtcagccagctcggcaactggagcccggcctc
cgcggtacggctgaccgacaccagcagctatccgacctggaagggcagcatcgccctgcctgacggtcagaacgtggaatggaagtgcctg
atccgtaacgaggcggacgcgacgctggtgcgccagtggcaatcgggcggcaacaaccaggtccaggccgctgccggcgcgagcacca
gcggctcgttctga SEQ ID NO: 182
Met Pro Glu Ala Phe Gly Leu Ala Ile Thr Pro Ser His Ser Arg Arg Gly Arg Leu Val Gly Val Ser
Arg Gly Gly Ser Leu Pro Met Pro Val Leu His Trp Pro Ala Phe Ile Leu Val Arg Arg Phe Val Ala
Gly His Pro Asn Lys His Lys Asn Arg Ser Ile Ala Met Ser His Thr Leu Arg Ala Ala Val Leu Ala
Ala Ile Leu Leu Pro Phe Pro Ala Leu Ala Asp Gln Ala Gly Lys Ser Pro Ala Gly Val Arg Tyr His
Gly Gly Asp Glu Ile Ile Leu Gln Gly Phe His Trp Asn Val Val Arg Glu Ala Pro Asn Asp Trp Tyr
Asn Ile Leu Arg Gln Gln Ala Ser Thr Ile Ala Ala Asp Gly Phe Ser Ala Ile Trp Met Pro Val Pro Trp
Arg Asp Phe Ser Ser Trp Thr Asp Gly Gly Lys Ser Gly Gly Gly Glu Gly Tyr Phe Trp His Asp Phe
Asn Lys Asn Gly Arg Tyr Gly Ser Asp Ala Gln Leu Arg Gln Ala Ala Gly Ala Leu Gly Gly Ala
Gly Val Lys Val Leu Tyr Asp Val Val Pro Asn His Met Asn Arg Gly Tyr Pro Asp Lys Glu Ile Asn
Leu Pro Ala Gly Gln Gly Phe Trp Arg Asn Asp Cys Thr Asp Pro Gly Asn Tyr Pro Asn Asp Cys
Asp Asp Gly Asp Arg Phe Ile Gly Gly Lys Ser Asp Leu Asn Thr Gly His Pro Gln Ile Tyr Gly Met
Phe Arg Asp Glu Leu Ala Asn Leu Arg Ser Gly Tyr Gly Ala Gly Gly Phe Arg Phe Asp Phe Val
Arg Gly Tyr Ala Pro Glu Arg Val Asp Ser Trp Met Ser Asp Ser Ala Asp Ser Ser Phe Cys Val Gly
Glu Leu Trp Lys Ser Pro Ser Glu Tyr Pro Ser Trp Asp Trp Arg Asn Thr Ala Ser Trp Gln Gln Ile Ile
Lys Asp Trp Ser Asp Arg Ala Lys Cys Pro Val Phe Asp Phe Ala Leu Lys Glu Arg Met Gln Asn
Gly Ser Val Ala Asp Trp Lys His Gly Leu Asn Gly Asn Pro Asp Pro Arg Trp Arg Glu Val Ala Val
Thr Phe Val Asp Asn His Asp Thr Gly Tyr Ser Pro Gly Gln Asn Gly Gly Gln His His Trp Ala Leu
Gln Asp Gly Leu Ile Arg Gln Ala Tyr Ala Tyr Ile Leu Thr Ser Pro Gly Thr Pro Val Val Tyr Trp Ser
His Met Tyr Asp Trp Gly Tyr Gly Asp Phe Ile Arg Gln Leu Ile Gln Val Arg Arg Thr Ala Gly Val
Arg Ala Asp Ser Ala Ile Ser Phe His Ser Gly Tyr Ser Gly Leu Val Ala Thr Val Ser Gly Ser His Gln
Thr Leu Val Val Ala Leu Asn Ser Asp Leu Ala Asn Pro Gly Gln Val Ala Ser Gly Ser Phe Ser Glu
Ala Val Asn Ala Ser Asn Gly Gln Val Arg Val Trp Arg Ser Gly Ser Gly Asp Gly Gly Gly Asn Asp
Gly Gly Glu Gly Gly Leu Val Asn Val Asn Phe Arg Cys Asp Asn Gly Val Thr Gln Met Gly Asp
Ser Val Tyr Ala Val Gly Asn Val Ser Gln Leu Gly Asn Trp Ser Pro Ala Ser Ala Val Arg Leu Thr
Asp Thr Ser Ser Tyr Pro Thr Trp Lys Gly Ser Ile Ala Leu Pro Asp Gly Gln Asn Val Glu Trp Lys
Cys Leu Ile Arg Asn Glu Ala Asp Ala Thr Leu Val Arg Gln Trp Gln Ser Gly Gly Asn Asn Gln Val
Gln Ala Ala Ala Gly Ala Ser Thr Ser Gly Ser Phe SEQ ID NO: 183
atgcaaacgattgcaaaaaaaggggatgaaacgatgaaagggaaaaaatggacagctttagctctaacactgccgctggctgctagcttatca
acaggcgttcacgccgaaaccgtacataaaggtaagtctgaagcaacagataaaaacggtgtcttttatgaggtgtatgtaaactcttttttacgata
caaataaagatggacatggtgatttaaaaggtctgacacaaaagttggattatttaaalgacggcaattctcatacaaagaatgatcttcaagtaaa
cgggatttggatgatgccagtcaaccc ttctcctagctatcataaatatgatgtaacggactattataacattgatcctcagtacggaaatctgcaag
attttcgcaagctgatgaaagaagcagacaaacgagacgtaaaagtcattatggaccttgttgtgaatcatacgagcagcgaacacccttggttt
caagctgcattaaaagataaaaacagcaagtacagagattactatatttgggctgataaaaaataccgatttgaatgaaaaaggatcttgggggca
gcaagtatggcataaagctccaaacggagagtattttacggaacgttttgggaaggaatgcctgacttaaattacgataaccctgaagtaagaa

Figure 16YYY aagaaatgattaacgtcggaaagttttggctaaagcaaggcgttaatggcttccgctagatgctgcgcttcatattttaaaggtcaaacacctga
aggcgctaagaaaaatatcctgtggtggaatgagtttagagatgcgatgaaaaaagaaaaccctaacgtatatctaacgggtgaagtatgggat
cagcctgaagtggtagctccttactatcaatcgcttgattctttatttaattttgatttagcaggaaaaattgtcagctctgtaaaagcaggaaatgatc
aaggaatcgccactgcagcagcggcaacagatgaactgttcaaatcatacaatccaaataaaattgacggcattttcttaaccaaccatgaccaa
aatcgcgtcatgagtgagctgagcggcgatgtgaacaaagcaaaatcagctgcttctatcttacttacgcttcctggcaacccgtatatttattacg
gtgaagaaattggcatgaccggtgaaaagcctgatgagttaatccgtgaaccattccgctggtacgaaggaaacggacttggacaaactagct
gggaaacacctgtatataacaaaggcggcaacggcgtgtctgtagaagtacaaaccaaacaaaaggattctttgttaaatcattatcgtgaaatg
attcgcgtgcgtcagcagcatgaagagttagtaaaaggaacgcttcaatctatttcagtagacagtaaagaagtggttgcctatagtcgcacgtat
aaaggcaactcgattagcgtgtatcataatatttcaaatcaacctgtaaaagtatctgtagcagcgaaaggtaaattgatttttgctagtgaaaaagg
tgctaaaaaagtcaaaaatcagcttgtaattccggctaatacaacggttttaataaaataa SEQ ID NO: 184
Met Gln Thr Ile Ala Lys Lys Gly Asp Glu Thr Met Lys Gly Lys Lys Trp Thr Ala Leu Ala Leu Thr
Leu Pro Leu Ala Ala Ser Leu Ser Thr Gly Val His Ala Glu Thr Val His Lys Gly Lys Ser Glu Ala
Thr Asp Lys Asn Gly Val Phe Tyr Glu Val Tyr Val Asn Ser Phe Tyr Asp Thr Asn Lys Asp Gly His
Gly Asp Leu Lys Gly Leu Thr Gln Lys Leu Asp Tyr Leu Asn Asp Gly Asn Ser His Thr Lys Asn
Asp Leu Gln Val Asn Gly Ile Trp Met Met Pro Val Asn Pro Ser Pro Ser Tyr His Lys Tyr Asp Val
Thr Asp Tyr Tyr Asn Ile Asp Pro Gln Tyr Gly Asn Leu Gln Asp Phe Arg Lys Leu Met Lys Glu Ala
Asp Lys Arg Asp Val Lys Val Ile Met Asp Leu Val Val Asn His Thr Ser Ser Glu His Pro Trp Phe
Gln Ala Ala Leu Lys Asp Lys Asn Ser Lys Tyr Arg Asp Tyr Tyr Ile Trp Ala Asp Lys Asn Thr Asp
Leu Asn Glu Lys Gly Ser Trp Gly Gln Gln Val Trp His Lys Ala Pro Asn Gly Glu Tyr Phe Tyr Gly
Thr Phe Trp Glu Gly Met Pro Asp Leu Asn Tyr Asp Asn Pro Glu Val Arg Lys Glu Met Ile Asn Val
Gly Lys Phe Trp Leu Lys Gln Gly Val Asn Gly Phe Arg Leu Asp Ala Ala Leu His Ile Phe Lys Gly
Gln Thr Pro Glu Gly Ala Lys Lys Asn Ile Leu Trp Trp Asn Glu Phe Arg Asp Ala Met Lys Lys Glu
Asn Pro Asn Val Tyr Leu Thr Gly Glu Val Trp Asp Gln Pro Glu Val Val Ala Pro Tyr Tyr Gln Ser
Leu Asp Ser Leu Phe Asn Phe Asp Leu Ala Gly Lys Ile Val Ser Ser Val Lys Ala Gly Asn Asp Gln
Gly Ile Ala Thr Ala Ala Ala Thr Asp Glu Leu Phe Lys Ser Tyr Asn Pro Asn Lys Ile Asp Gly
Ile Phe Leu Thr Asn His Asp Gln Asn Arg Val Met Ser Glu Leu Ser Gly Asp Val Asn Lys Ala Lys
Ser Ala Ala Ser Ile Leu Leu Thr Leu Pro Gly Asn Pro Tyr Ile Tyr Tyr Gly Glu Glu Ile Gly Met Thr
Gly Glu Lys Pro Asp Glu Leu Ile Arg Glu Pro Phe Arg Trp Tyr Glu Gly Asn Gly Leu Gly Gln Thr
Ser Trp Glu Thr Pro Val Tyr Asn Lys Gly Gly Asn Gly Val Ser Val Glu Val Gln Thr Lys Gln Lys
Asp Ser Leu Leu Asn His Tyr Arg Glu Met Ile Arg Val Arg Gln Gln His Glu Glu Leu Val Lys Gly
Thr Leu Gln Ser Ile Ser Val Asp Ser Lys Glu Val Val Ala Tyr Ser Arg Thr Tyr Lys Gly Asn Ser Ile
Ser Val Tyr His Asn Ile Ser Asn Gln Pro Val Lys Val Ser Val Ala Ala Lys Gly Lys Leu Ile Phe Ala
Ser Glu Lys Gly Ala Lys Lys Val Lys Asn Gln Leu Val Ile Pro Ala Asn Thr Thr Val Leu Ile Lys SEQ ID NO: 185
atgaaactgatgaaagggaaaaaatggacagctttagctctaacactgccgctggctgctagcttatcaacaggcgttcacgccgaaactgtac
ataaaggtaaagctccaacagcagataaaaacggtgtcttttatgaggtgtatgtaaactcttttacgatgcaaataaagatggacatggtgattta
aaaggtcttacacaaaagctggactatttaaatgacggaaattctcatacaaagaatgatcttcaagtaaacgggatttggatgatgccagtcaac
ccttctcctagctatcataaatatgatgtaacggattattataacattgatccgcagtacggaaatctgcaagattttcgcaagctgatgaaagaagc
agacaaacgagacgtaaaagtcattatggaccttgttgtgaatcatacgagcagcgaacacccttggtttcaagctgcgttaaaagataaaaaca
gcaagtacagagattactatatttgggctgataaaaataccgacttgaatgaaaaaggatcttggggacagcaagtatggcataaagctccaaac
ggagagtattttacggaacgttttgggaaggaatgcctgacttaaattacgataaccctgaagtaagaaaagaaatgattaacgtcggaaagtttt
ggctaaagcaaggcgttgatggcttccgcttagatgctgcgcttcatattttaaaggtcaaacgcctgaaggcgctaagaaaaatattctgtggt
ggaatgagtttagagatgcgatgaaaaaagaaaacccataacgtatatctaacgggtgaagtatgggatcagcctgaagtggtagctccttactat
caatcgcttgattccctatttaactttgatttagcagggaaaattgtcagttctgtaaaagcaggaaatgatcaaggaatcgccactgcagcagcgg
caacggatgagctgttcaaatcatacaatccaaataaaattgacggcattttcttaaccaaccatgaccaaaaccgcgtcatgagtgaactgatcg
gcgatgtgaacaaagcaaaatcagctgcttctatcttacttacgcttcctggcaacccgtatatttattacggtgaagaaattggcatgaccggtga
aaagcctgatgagttaatccgtgaaccgttccgctggtacgaaggaaacggacttggacaaaccagctgggaaacacctgtatataacaaagg

Figure 16ZZZ cggcaacggcgtgtctgtagaagcacaaaccaaacaaaaggattctttgttaaatcattaccgtgaaatgattcgcgtgcgtcagcagcatgaag
agttagtaaaaggaacgcttcaatctatttagtagacagtaaagaagttgttgcctatagccgtacgtataaagacaactcgattagcgtgtatcat
aatatttcaaatcaaccggtaaaagtatctgtagcagcaaaaggtaaattaatttttgctagtgaaaaaggtgctaaaaaagtcaagaatcagcttg
tgattccggctaatacaacggttttaataaaataa SEQ ID NO: 186
Met Lys Leu Met Lys Gly Lys Lys Trp Thr Ala Leu Ala Leu Thr Leu Pro Leu Ala Ala Ser Leu Ser
Thr Gly Val His Ala Glu Thr Val His Lys Gly Lys Ala Pro Thr Ala Asp Lys Asn Gly Val Phe Tyr
Glu Val Tyr Val Asn Ser Phe Tyr Asp Ala Asn Lys Asp Gly His Gly Asp Leu Lys Gly Leu Thr
Gln Lys Leu Asp Tyr Leu Asn Asp Gly Asn Ser His Thr Lys Asn Asp Leu Gln Val Asn Gly Ile Trp
Met Met Pro Val Asn Pro Ser Pro Ser Tyr His Lys Tyr Asp Val Thr Asp Tyr Tyr Asn Ile Asp Pro
Gln Tyr Gly Asn Leu Gln Asp Phe Arg Lys Leu Met Lys Glu Ala Asp Lys Arg Asp Val Lys Val
Ile Met Asp Leu Val Val Asn His Thr Ser Ser Glu His Pro Trp Phe Gln Ala Ala Leu Lys Asp Lys
Asn Ser Lys Tyr Arg Asp Tyr Tyr Ile Trp Ala Asp Lys Asn Thr Asp Leu Asn Glu Lys Gly Ser Trp
Gly Gln Gln Val Trp His Lys Ala Pro Asn Gly Glu Tyr Phe Tyr Gly Thr Phe Trp Glu Gly Met Pro
Asp Leu Asn Tyr Asp Asn Pro Glu Val Arg Lys Glu Met Ile Asn Val Gly Lys Phe Trp Leu Lys
Gln Gly Val Asp Gly Phe Arg Leu Asp Ala Ala Leu His Ile Phe Lys Gly Gln Thr Pro Glu Gly Ala
Lys Lys Asn Ile Leu Trp Trp Asn Glu Phe Arg Asp Ala Met Lys Lys Glu Asn Pro Asn Val Tyr Leu
Thr Gly Glu Val Trp Asp Gln Pro Glu Val Val Ala Pro Tyr Tyr Gln Ser Leu Asp Ser Leu Phe Asn
Phe Asp Leu Ala Gly Lys Ile Val Ser Ser Val Lys Ala Gly Asn Asp Gln Gly Ile Ala Thr Ala Ala
Ala Ala Thr Asp Glu Leu Phe Lys Ser Tyr Asn Pro Asn Lys Ile Asp Gly Ile Phe Leu Thr Asn His
Asp Gln Asn Arg Val Met Ser Glu Leu Ile Gly Asp Val Asn Lys Ala Lys Ser Ala Ala Ser Ile Leu
Leu Thr Leu Pro Gly Asn Pro Tyr Ile Tyr Tyr Gly Glu Glu Ile Gly Met Thr Gly Glu Lys Pro Asp
Glu Leu Ile Arg Glu Pro Phe Arg Trp Tyr Glu Gly Asn Gly Leu Gly Gln Thr Ser Trp Glu Thr Pro
Val Tyr Asn Lys Gly Gly Asn Gly Val Ser Val Glu Ala Gln Thr Lys Gln Lys Asp Ser Leu Leu Asn
His Tyr Arg Glu Met Ile Arg Val Arg Gln Gln His Glu Glu Leu Val Lys Gly Thr Leu Gln Ser Ile
Leu Val Asp Ser Lys Glu Val Val Ala Tyr Ser Arg Thr Tyr Lys Asp Asn Ser Ile Ser Val Tyr His
Asn Ile Ser Asn Gln Pro Val Lys Val Ser Val Ala Ala Lys Gly Lys Leu Ile Phe Ala Ser Glu Lys
Gly Ala Lys Lys Val Lys Asn Gln Leu Val Ile Pro Ala Asn Thr Thr Val Leu Ile Lys SEQ ID NO: 187
ttgtatctcatccaggaggggcacatgcgttttccgcccattattcacccgcttaccggcctggccgttccggttggagctctgcgtaccgcacag
agctgcggcataggggagtttgccgacttgccggttcttgccgaattctgcaaaaaagccggatttgatcttgtacagcttcttccggtcaatgac
accggcacagaaagttctccatacagcgcgctttctgcctttgccctgcacccgctgtatatcaggctttccgacctgcctgaagcagcgggtttc
gaaaagcagattacagatctgaaaagccggtttgaggacttgcctcgtttcagctatacggagctgcgccgtgccaaactggatatcctgcgtgc
agtgtttgataaaaacaaggcaaccatcatcggcagtgccgaactggaagcctggatttcagataaccctggatcatcgaatatgcggttttat
gaaccagaaacaccgcaactttgaagccggctggaaacattgggaaaagctgcgcaaccccactcataacgaaatacaaaaaacctggcag
ggtaaaacctggcaggctgaccatcaattcttgcatggctgcagatgcggctggaccagcagtttactgccgccgctacagagtgcaacgcc
ctgggtgtctatcttaagggcgatataccctataatgatgaacgaggattccgcagatgcctgggcgaatccggaattcttccgtgacgatcttcgg
gccggaagtcccctgacggtgaaaaccccagggacaaaactggggcttcccatttataactgggaaaaccttgcaaatgacgggtacag
ctggtggaaaaaacgtctgaagcacagcgcacggtattaccatgcctaccgcattgaccatattcttgggttttccggatatgggctatacctat
ggcgaatactccggctacctgggatggcccttgccgcatgaaccggtaagtgcagcagaactggcagaacggggcttttccaaggaccgctt
gcgctggcttaccgaaccccacttgcctacacgggcagccgaggaagcgaataactgggactatctgggaacacacggctatctgaatcaga
tcatgaaccgtatcggtgaagaagaactatggctgttcaagcccgagatcacctgcgaggcagatatacgaaacacaaacctgccggatgccc
tgaaagaggttctggtacggcagtggaaaaaccggctgctgcaggttaccggccgcgacgaaaaaggacggacaatctactatccgctgtgg
cgtttccgtgacagcactgcatggcagacgcttaccgatggcgagaaacactccctggaagagctgttcgcccaaaaagcggcgcacaatga
aaccctgtggcgagaacaggcggtggaacttctgggtgagctgacgcgatctacggatatgcttgcctgtgctgaagatctgggaagtattccc
cacagtgtaccggaagtgctttcaaaccttcaatttacagtctgcgggttacccgctgggcccgccaatgggatgccccggccagcccttttca
cagactggaggagtatccgctcatgtcggtagcgaccccatcggttcatgattcctctaccctgcgcggatggtgggaaaccgaaggcggcga
ccgggcctttatggacgcatggcctccggaacaggatgcatacgcaggagcaggccgccatgagttcgaaggcgcctggggacccgcca

Figure 16AAAA ggcatcctgggtactccgtaaactctgcgaagcccgttccgcgctctgtgttttccccatccaggatattttggccctgtcttcagactttatgcaat
gacagcggacgaggaacgcatcaatattccgggcagtgtatccggatttaactggacataccggttgcctgcggcaatcgaggatttatctaaa
aacagccaacttataaccgcaatccagaccgcgttgcaggaccgccgggcgaggaaggcacaaggagcacagcaatga SEQ ID NO: 188
Met Tyr Leu Ile Gln Glu Gly His Met Arg Phe Pro Pro Ile Ile His Pro Leu Thr Gly Leu Ala Val Pro
Val Gly Ala Leu Arg Thr Ala Gln Ser Cys Gly Ile Gly Glu Phe Ala Asp Leu Pro Val Leu Ala Glu
Phe Cys Lys Lys Ala Gly Phe Asp Leu Val Gln Leu Leu Pro Val Asn Asp Thr Gly Thr Glu Ser Ser
Pro Tyr Ser Ala Leu Ser Ala Phe Ala Leu His Pro Leu Tyr Ile Arg Leu Ser Asp Leu Pro Glu Ala
Ala Gly Phe Glu Lys Gln Ile Thr Asp Leu Lys Ser Arg Phe Glu Asp Leu Pro Arg Phe Ser Tyr Thr
Glu Leu Arg Arg Ala Lys Leu Asp Ile Leu Arg Ala Val Phe Asp Lys Asn Lys Ala Thr Ile Ile Gly
Ser Ala Glu Leu Glu Ala Trp Ile Ser Asp Asn Pro Trp Ile Ile Glu Tyr Ala Val Phe Met Asn Gln
Lys His Arg Asn Phe Glu Ala Gly Trp Lys His Trp Glu Lys Leu Arg Asn Pro Thr His Asn Glu Ile
Gln Lys Thr Trp Gln Gly Lys Thr Trp Gln Ala Asp His Gln Phe Phe Ala Trp Leu Gln Met Arg Leu
Asp Gln Gln Phe Thr Ala Ala Ala Thr Glu Cys Asn Ala Leu Gly Val Tyr Leu Lys Gly Asp Ile Pro
Ile Met Met Asn Glu Asp Ser Ala Asp Ala Trp Ala Asn Pro Glu Phe Phe Arg Asp Asp Leu Arg
Ala Gly Ser Pro Pro Asp Gly Glu Asn Pro Gln Gly Gln Asn Trp Gly Phe Pro Ile Tyr Asn Trp Glu
Asn Leu Ala Asn Asp Gly Tyr Ser Trp Trp Lys Lys Arg Leu Lys His Ser Ala Arg Tyr Tyr His Ala
Tyr Arg Ile Asp His Ile Leu Gly Phe Phe Arg Ile Trp Ala Ile Pro Tyr Gly Glu Tyr Ser Gly Tyr Leu
Gly Trp Pro Leu Pro His Glu Pro Val Ser Ala Ala Glu Leu Ala Glu Arg Gly Phe Ser Lys Asp Arg
Leu Arg Trp Leu Thr Glu Pro His Leu Pro Thr Arg Ala Ala Glu Glu Ala Asn Asn Trp Asp Tyr Leu
Gly Thr His Gly Tyr Leu Asn Gln Ile Met Asn Arg Ile Gly Glu Glu Glu Leu Trp Leu Phe Lys Pro
Glu Ile Thr Cys Glu Ala Asp Ile Arg Asn Thr Asn Leu Pro Asp Ala Leu Lys Glu Val Leu Val Arg
Gln Trp Lys Asn Arg Leu Leu Gln Val Thr Gly Arg Asp Glu Lys Gly Arg Thr Ile Tyr Tyr Pro Leu
Trp Arg Phe Arg Asp Ser Thr Ala Trp Gln Thr Leu Thr Asp Gly Glu Lys His Ser Leu Glu Glu Leu
Phe Ala Gln Lys Ala Ala His Asn Glu Thr Leu Trp Arg Glu Gln Ala Val Glu Leu Leu Gly Glu Leu
Thr Arg Ser Thr Asp Met Leu Ala Cys Ala Glu Asp Leu Gly Ser Ile Pro His Ser Val Pro Glu Val
Leu Ser Asn Leu Ser Ile Tyr Ser Leu Arg Val Thr Arg Trp Ala Arg Gln Trp Asp Ala Pro Gly Gln
Pro Phe His Arg Leu Glu Glu Tyr Pro Leu Met Ser Val Ala Thr Pro Ser Val His Asp Ser Ser Thr
Leu Arg Gly Trp Trp Glu Thr Glu Gly Gly Asp Arg Ala Phe Met Asp Ala Trp Pro Pro Glu Gln
Asp Ala Tyr Ala Gly Ala Gly Arg His Glu Phe Glu Gly Ala Trp Gly Pro Arg Gln Ala Ser Trp Val
Leu Arg Lys Leu Cys Glu Ala Arg Ser Ala Leu Cys Val Phe Pro Ile Gln Asp Ile Leu Ala Leu Ser
Ser Asp Phe Tyr Ala Met Thr Ala Asp Glu Glu Arg Ile Asn Ile Pro Gly Ser Val Ser Gly Phe Asn
Trp Thr Tyr Arg Leu Pro Ala Ala Ile Glu Asp Leu Ser Lys Asn Ser Gln Leu Ile Thr Ala Ile Gln Thr
Ala Leu Gln Asp Arg Arg Ala Arg Lys Ala Gln Gly Ala Gln Gln SEQ ID NO: 189
atgcaaacgattgcaaaaaaaggggatgaaacgatgaaagggaaaaaatggacagctttagctctaacactgccgctggctgctagcttatca
acaggcgttcacgccgaaaccgtacataaaggtaaatctccagctgcagataaaaacggtgtcttttatgaggtgtatgtaaactcttttttacgatg
caaataaagatggacatggtgatttaaaaggtcttacacaaaaactggactatttaaatgatggcaattctcatacaaagaatgatcttcaagtaaa
cgggatttggatgatgccgatcaacccttctcctagctatcataaatatgatgtaacggactattataacattgattctcagtacggaaatctgcaag
attttcgcaagctaatgaaagaagcagataaacgagatgtaaaagttattatggacctcgttgtgaatcatacgagcagtgaacacccttggtttca
agctgcgttaaaagataaaaacagcaagtacagagattactatatttgggctgataaaaataccgatttgaatgaaaaaggatcttggggacaac
aagtatggcacaaagctccaaacggagagtattttttacggaacgttctgggaaggaatgcctgacttaaattacgataaccctgaagtaagaaaa
gaaatgattaacgtcggaaagtttggctaaagcaaggcgttgacggcttccgcttagatgctgccttcatatcttaaaggtcaaacacctgaa
ggcgctaagaaaatattgtgtggtggaatgaatttagagatgcgatgaaaaaagaaaacccgaacgtatatctaacgggcgaagtatgggatc
agccggaagtggtagctccttattatcagtcgcttgattccctatttaactttgatttagcaggaaaaattgtcagctctgtaaaagcaggaaatgatc
aaggaatcgctactgcagcagcggcaacagatgaactgttcaaatcatacaatccaaataaaattgacggcattttcttaaccaatcatgaccaaa
atcgcgtcatgagtgagttaagcggagatgtcaataaagcaaagtcagctgcctctatcttacttacgcttcctggaaatccgtatatttattacggt
gaagaaatcggcatgaccggtgaaaagcctgatgaattaatccgtgaaccgttccgctggtacgaaggaaacggacttggacaaactagttgg

Figure 16BBBB gaaacacctgtatacaataaaggcggcaacggcgtgtctgtagaagcacaaaccaaacaaaaggactctttgttaaatcattaccgtgaaatgat
tcgcgtgcgtcagcagcacgaagagttagtaaaaggaacgcttcaatctatttcagtagacagtaaagaagttgttgcttatagccgtacgtataa
aggcaactccattagtgtgtatcataatatttcaaatcaacctgtaaaagtatctgtagcagcgaaaggtaaattgattttttgctagtgaaaaaggtg
ctaaaaaggtcaaaaatcagcttgtgattccggcgaatacaacggttttagtaaaataa SEQ ID NO: 190
Met Gln Thr Ile Ala Lys Lys Gly Asp Glu Thr Met Lys Gly Lys Lys Trp Thr Ala Leu Ala Leu Thr
Leu Pro Leu Ala Ala Ser Leu Ser Thr Gly Val His Ala Glu Thr Val His Lys Gly Lys Ser Pro Ala
Ala Asp Lys Asn Gly Val Phe Tyr Glu Val Tyr Val Asn Ser Phe Tyr Asp Ala Asn Lys Asp Gly His
Gly Asp Leu Lys Gly Leu Thr Gln Lys Leu Asp Tyr Leu Asn Asp Gly Asn Ser His Thr Lys Asn
Asp Leu Gln Val Asn Gly Ile Trp Met Met Pro Ile Asn Pro Ser Pro Ser Tyr His Lys Tyr Asp Val
Thr Asp Tyr Tyr Asn Ile Asp Ser Gln Tyr Gly Asn Leu Gln Asp Phe Arg Lys Leu Met Lys Glu Ala
Asp Lys Arg Asp Val Lys Val Ile Met Asp Leu Val Val Asn His Thr Ser Ser Glu His Pro Trp Phe
Gln Ala Ala Leu Lys Asp Lys Asn Ser Lys Tyr Arg Asp Tyr Tyr Ile Trp Ala Asp Lys Asn Thr Asp
Leu Asn Glu Lys Gly Ser Trp Gly Gln Gln Val Trp His Lys Ala Pro Asn Gly Glu Tyr Phe Tyr Gly
Thr Phe Trp Glu Gly Met Pro Asp Leu Asn Tyr Asp Asn Pro Glu Val Arg Lys Glu Met Ile Asn Val
Gly Lys Phe Trp Leu Lys Gln Gly Val Asp Gly Phe Arg Leu Asp Ala Ala Leu His Ile Phe Lys Gly
Gln Thr Pro Glu Gly Ala Lys Lys Asn Ile Val Trp Trp Asn Glu Phe Arg Asp Ala Met Lys Lys Glu
Asn Pro Asn Val Tyr Leu Thr Gly Glu Val Trp Asp Gln Pro Glu Val Val Ala Pro Tyr Tyr Gln Ser
Leu Asp Ser Leu Phe Asn Phe Asp Leu Ala Gly Lys Ile Val Ser Ser Val Lys Ala Gly Asn Asp Gln
Gly Ile Ala Thr Ala Ala Ala Ala Thr Asp Glu Leu Phe Lys Ser Tyr Asn Pro Asn Lys Ile Asp Gly
Ile Phe Leu Thr Asn His Asp Gln Asn Arg Val Met Ser Glu Leu Ser Gly Asp Val Asn Lys Ala Lys
Ser Ala Ala Ser Ile Leu Leu Thr Leu Pro Gly Asn Pro Tyr Ile Tyr Tyr Gly Glu Glu Ile Gly Met Thr
Gly Glu Lys Pro Asp Glu Leu Ile Arg Glu Pro Phe Arg Trp Tyr Glu Gly Asn Gly Leu Gly Gln Thr
Ser Trp Glu Thr Pro Val Tyr Asn Lys Gly Gly Asn Gly Val Ser Val Glu Ala Gln Thr Lys Gln Lys
Asp Ser Leu Leu Asn His Tyr Arg Glu Met Ile Arg Val Arg Gln Gln His Glu Glu Leu Val Lys Gly
Thr Leu Gln Ser Ile Ser Val Asp Ser Lys Glu Val Val Ala Tyr Ser Arg Thr Tyr Lys Gly Asn Ser Ile
Ser Val Tyr His Asn Ile Ser Asn Gln Pro Val Lys Val Ser Val Ala Ala Lys Gly Lys Leu Ile Phe Ala
Ser Glu Lys Gly Ala Lys Lys Val Lys Asn Gln Leu Val Ile Pro Ala Asn Thr Thr Val Leu Val Lys SEQ ID NO: 191
atgcaaacgattgcaaaaaaaggggatgaaacgatgaaagggaaaaaatggacagctttagctctaacactgccgctggctgctagcttatca
acaggcgttcacgccgaaaccgtacataaaggtaaatctccaacagcagataaaaacggtgtcttttatgaagtgtatgtaaactcttttttacgatg
caaataaagatggacatggtgacttaaaaggtcttacacaaaagttggactatttaaatgacggcaattctcatacaaaaaatgatcttcaagtaaa
cgggatttggatgatgccagtcaacccttctcctagctatcataaatatgatgtaacggactattataacattgatccgcagtacggaaatctgcaa
gattttcgcaagctgatgaaagaagcagacaaacgagacgtaaaagtcattatggaccttgttgtgaatcatacgagcagtgaacacccttggttt
caagctgcgttaaaagataaaaacagcaagtacagagattactatatttggctgataaaaataccgacttgaatgaaaaaggatcttggggaca
acaagtatggcataaagctccaaacggagagtattttttacggaacgttctgggaaggaatgcctgacttaaattacgataaccctgaagtaagaa
agaaatgattaacgtcggaaagttttggctaaagcaaggcgttgacgggttccgcttagatgctgcgcttcatattttaaaggtcaaacagctga
aggcgctaagaaaaatatcctgtggtggaatgagtttagagatgcgatgaaaaaagaaaatcc aatgtatatctaacgggtgaagtatgggat
cagcctgaagtggtagctccttattatcaatcgcttgattcttatttaattttgatttagcaggaaaaattgtcagctctgtaaaagcaggaaatgatc
aaggaatcgccactgcagcagcagcaacagatgaactgttcaaatcatacaatccaaacaaaattgatggcatattcttaaccaaccatgaccaa
aatcgcgtcatgagtgagctgagcggcgatgtgagcaaagcaaatcagctgcttctatcttacttacgcttcctggcaacccgtatatttattacg
gtgaagaaatcggcatgaccggtgaaaagcctgatgaattaatccgtgaaccgttccgctggtacgaaggaaacggacttggacaaaccagtt
gggaaacacctgtatacaataaaggcggaaacggtgtgtctgtagaagcacaaaccaaacaaaaggattctttgttaaatcattaccgtgaaatg
attcgcgtgcgtcagcagcatgaagagttagtaaaaggaacgcttcaatctatttcagtagacagtaaagaagttgttgcttatagccgtacgtata
aaggcaactccattagtgtgtatcataatatttcaaatcaaccggtaaaagtatctgtagcagcgaaaggtaaattgattttttgctagtgaaaaaggt
gctaagaaagtcaaaaatcagcttgtggttccggcgaatacaacggttttaatgaaataa

SEQ ID NO: 192

Figure 16CCCC

Met Gln Thr Ile Ala Lys Lys Gly Asp Glu Thr Met Lys Gly Lys Lys Trp Thr Ala Leu Ala Leu Thr
Leu Pro Leu Ala Ala Ser Leu Ser Thr Gly Val His Ala Glu Thr Val His Lys Gly Lys Ser Pro Thr
Ala Asp Lys Asn Gly Val Phe Tyr Glu Val Tyr Val Asn Ser Phe Tyr Asp Ala Asn Lys Asp Gly His
Gly Asp Leu Lys Gly Leu Thr Gln Lys Leu Asp Tyr Leu Asn Asp Gly Asn Ser His Thr Lys Asn
Asp Leu Gln Val Asn Gly Ile Trp Met Met Pro Val Asn Pro Ser Pro Ser Tyr His Lys Tyr Asp Val
Thr Asp Tyr Tyr Asn Ile Asp Pro Gln Tyr Gly Asn Leu Gln Asp Phe Arg Lys Leu Met Lys Glu Ala
Asp Lys Arg Asp Val Lys Val Ile Met Asp Leu Val Val Asn His Thr Ser Ser Glu His Pro Trp Phe
Gln Ala Ala Leu Lys Asp Lys Asn Ser Lys Tyr Arg Asp Tyr Tyr Ile Trp Ala Asp Lys Asn Thr Asp
Leu Asn Glu Lys Gly Ser Trp Gly Gln Gln Val Trp His Lys Ala Pro Asn Gly Glu Tyr Phe Tyr Gly
Thr Phe Trp Glu Gly Met Pro Asp Leu Asn Tyr Asp Asn Pro Glu Val Arg Lys Glu Met Ile Asn Val
Gly Lys Phe Trp Leu Lys Gln Gly Val Asp Gly Phe Arg Leu Asp Ala Ala Leu His Ile Phe Lys Gly
Gln Thr Ala Glu Gly Ala Lys Lys Asn Ile Leu Trp Trp Asn Glu Phe Arg Asp Ala Met Lys Lys Glu
Asn Pro Asn Val Tyr Leu Thr Gly Glu Val Trp Asp Gln Pro Glu Val Val Ala Pro Tyr Tyr Gln Ser
Leu Asp Ser Leu Phe Asn Phe Asp Leu Ala Gly Lys Ile Val Ser Ser Val Lys Ala Gly Asn Asp Gln
Gly Ile Ala Thr Ala Ala Ala Ala Thr Asp Glu Leu Phe Lys Ser Tyr Asn Pro Asn Lys Ile Asp Gly
Ile Phe Leu Thr Asn His Asp Gln Asn Arg Val Met Ser Glu Leu Ser Gly Asp Val Ser Lys Ala Lys
Ser Ala Ala Ser Ile Leu Leu Thr Leu Pro Gly Asn Pro Tyr Ile Tyr Tyr Gly Glu Glu Ile Gly Met Thr
Gly Glu Lys Pro Asp Glu Leu Ile Arg Glu Pro Phe Arg Trp Tyr Glu Gly Asn Gly Leu Gly Gln Thr
Ser Trp Glu Thr Pro Val Tyr Asn Lys Gly Gly Asn Gly Val Ser Val Glu Ala Gln Thr Lys Gln Lys
Asp Ser Leu Leu Asn His Tyr Arg Glu Met Ile Arg Val Arg Gln Gln His Glu Glu Leu Val Lys Gly
Thr Leu Gln Ser Ile Ser Val Asp Ser Lys Glu Val Val Ala Tyr Ser Arg Thr Tyr Lys Gly Asn Ser Ile
Ser Val Tyr His Asn Ile Ser Asn Gln Pro Val Lys Val Ser Val Ala Ala Lys Gly Lys Leu Ile Phe Ala
Ser Glu Lys Gly Ala Lys Lys Val Lys Asn Gln Leu Val Val Pro Ala Asn Thr Thr Val Leu Met Lys

SEQ ID NO: 193
atgaaattcaaaaagagtttatctgccgggctcctttgttcggaggtctgagcggtgtgacaccatccgtcgctgcggaggtgccacgaaccgc
atttgtccatttattcgaatggagttggccggatattgccaccgaatgcgaaacctttcttggccctaaggggttctctgcggttcaggtgtctccgc
cgcaaaaaagcgtcagcaatgctgcctggtgggcgcgctaccaacctgttagttactcttttgaagggcgcagtggaacccgggctcaatttgc
ggatatggtccagcgttgtaaagcggtgggggtcgatatttatctggatgcggtgatcaaccatatggcagcacaagatcgctatttccagaagt
accttacagcagtaatgattttcacagttgcacgggcgatatcgattattccaaccgctggtcgattcaaaattgcgatctggttgggctgaacgat
ctcaaaaccgagtcagaatacgttcggcagaaaattgcagactatatgaacgatgcgctcagtctgggcgtggcggggtttcggattgatgccg
ccaagcatatcccggccggcgacatcgcggcgatcaagagcaagctcaacggcagcccgtatatctatcaggaggttatcggggcggcagg
ggagccggtacaaaccagcgagtacacgtatattggagacgtgacggaatttaacttcgcccggaccatcgggcctaaatttaagcaaggtaat
attaaagacctgcaggggattggttcgtggagcggctggctgagcagcgacgatgcggtgacctttgtgaccaaccatgacgaagaacgcca
taaccctggccaggttctcagccatcaggactttggcaatctgtatttcctcggtaacgtgtttactctggcgtatccttacggctacccaaaagtga
tgtcggggtactacttcagtaattttgatgccgggccaccatcgacaggggtacattctggtaatgcgtgtggctttgatggcggtgattgggtctg
cgaacacaaatggcgtggtgtagccaacatggtggcgtttcgcaaccacacagcagcccagtggcaggtcactgactggtgggacgatggtt
acaatcaggtggcgtttggtcgtggcgggctgggctttgtggtgatcaatcgagatgacaataaaggcatcaatcagagtttccagacgggaat
gcccgctggcgagtattgtgacatcattgccggtgatttcgacacccgagagcggtcattgcagcgctacgacgatcaccgtcgacagtcaggg
gtatgcacattttactgtcggtagtcatcaggccgctgcgattcacattggcgcgaaactcggctccgtgtgccaggactgtggcggcacggcc
gcagagacaaaagtctgctttgacaatgcacaaaactttagccaaccgtatttgcattactggaatgtcaatgcggatcaggccgtagcgaatgc
aacctggccgggcgtcgcgatgacggctgaaaatggcggttactgctacgattttggtgtcggtctcaattcacttcaggtaattttcagcgataa
cggcgccagccaaaccgctgatctgaccgccagcagtccgacgttgtgttaccagaacggaacgtggcgtgacagtgacttctgtcagagta
gcaatgtgggcaacgagagttggtatttccgtggaacctcaaacgggttggggcgtgagcgcactcacttatgaggctgcgacaggcctgtaca
ctacggtgcagagctttaacggggaggagtcgcccgcacgctttaaaattgatgatggcaactggagtgagtcgtatccaagtgctgattatcaa
gtcggtgattatgccacctacacgatcacgtttgacagccagacgaaggccatcaccgtgacttcgcagtaa SEQ ID NO: 194
Met Lys Phe Lys Lys Ser Leu Ser Ala Gly Leu Leu Leu Phe Gly Gly Leu Ser Gly Val Thr Pro Ser
Val Ala Ala Glu Val Pro Arg Thr Ala Phe Val His Leu Phe Glu Trp Ser Trp Pro Asp Ile Ala Thr

Figure 16DDDD

Glu Cys Glu Thr Phe Leu Gly Pro Lys Gly Phe Ser Ala Val Gln Val Ser Pro Pro Gln Lys Ser Val
Ser Asn Ala Ala Trp Trp Ala Arg Tyr Gln Pro Val Ser Tyr Ser Phe Glu Gly Arg Ser Gly Thr Arg
Ala Gln Phe Ala Asp Met Val Gln Arg Cys Lys Ala Val Gly Val Asp Ile Tyr Leu Asp Ala Val Ile
Asn His Met Ala Ala Gln Asp Arg Tyr Phe Pro Glu Val Pro Tyr Ser Ser Asn Asp Phe His Ser Cys
Thr Gly Asp Ile Asp Tyr Ser Asn Arg Trp Ser Ile Gln Asn Cys Asp Leu Val Gly Leu Asn Asp Leu
Lys Thr Glu Ser Glu Tyr Val Arg Gln Lys Ile Ala Asp Tyr Met Asn Asp Ala Leu Ser Leu Gly Val
Ala Gly Phe Arg Ile Asp Ala Ala Lys His Ile Pro Ala Gly Asp Ile Ala Ala Ile Lys Ser Lys Leu Asn
Gly Ser Pro Tyr Ile Tyr Gln Glu Val Ile Gly Ala Ala Gly Glu Pro Val Gln Thr Ser Glu Tyr Thr Tyr
Ile Gly Asp Val Thr Glu Phe Asn Phe Ala Arg Thr Ile Gly Pro Lys Phe Lys Gln Gly Asn Ile Lys
Asp Leu Gln Gly Ile Gly Ser Trp Ser Gly Trp Leu Ser Ser Asp Asp Ala Val Thr Phe Val Thr Asn
His Asp Glu Glu Arg His Asn Pro Gly Gln Val Leu Ser His Gln Asp Phe Gly Asn Leu Tyr Phe Leu
Gly Asn Val Phe Thr Leu Ala Tyr Pro Tyr Gly Tyr Pro Lys Val Met Ser Gly Tyr Tyr Phe Ser Asn
Phe Asp Ala Gly Pro Pro Ser Thr Gly Val His Ser Gly Asn Ala Cys Gly Phe Asp Gly Gly Asp Trp
Val Cys Glu His Lys Trp Arg Gly Val Ala Asn Met Val Ala Phe Arg Asn His Thr Ala Ala Gln Trp
Gln Val Thr Asp Trp Trp Asp Asp Gly Tyr Asn Gln Val Ala Phe Gly Arg Gly Gly Leu Gly Phe
Val Val Ile Asn Arg Asp Asp Asn Lys Gly Ile Asn Gln Ser Phe Gln Thr Gly Met Pro Ala Gly Glu
Tyr Cys Asp Ile Ile Ala Gly Asp Phe Asp Thr Gln Ser Gly His Cys Ser Ala Thr Thr Ile Thr Val
Asp Ser Gln Gly Tyr Ala His Phe Thr Val Gly Ser His Gln Ala Ala Ala Ile His Ile Gly Ala Lys Leu
Gly Ser Val Cys Gln Asp Cys Gly Gly Thr Ala Ala Glu Thr Lys Val Cys Phe Asp Asn Ala Gln
Asn Phe Ser Gln Pro Tyr Leu His Tyr Trp Asn Val Asn Ala Asp Gln Ala Val Ala Asn Ala Thr Trp
Pro Gly Val Ala Met Thr Ala Glu Asn Gly Gly Tyr Cys Tyr Asp Phe Gly Val Gly Leu Asn Ser Leu
Gln Val Ile Phe Ser Asp Asn Gly Ala Ser Gln Thr Ala Asp Leu Thr Ala Ser Ser Pro Thr Leu Cys
Tyr Gln Asn Gly Thr Trp Arg Asp Ser Asp Phe Cys Gln Ser Ser Asn Val Gly Asn Glu Ser Trp Tyr
Phe Arg Gly Thr Ser Asn Gly Trp Gly Val Ser Ala Leu Thr Tyr Glu Ala Ala Thr Gly Leu Tyr Thr
Thr Val Gln Ser Phe Asn Gly Glu Glu Ser Pro Ala Arg Phe Lys Ile Asp Asp Gly Asn Trp Ser Glu
Ser Tyr Pro Ser Ala Asp Tyr Gln Val Gly Asp Tyr Ala Thr Tyr Thr Ile Thr Phe Asp Ser Gln Thr
Lys Ala Ile Thr Val Thr Ser Gln

SEQ ID NO: 195
atgctgacagaccgtttctttgatggcgatacatcaaacaacgacccttacaaccagaactacgatgctaaaaacgaccggggaacttatcagg
gcggcgatttttaaaggaatcacgcaaaaattggattatctcgataagctaggcgtgaacacaatctggatcagcccgatcgtggaaaatatcaag
catgatgtccgttatgacaactctgaagggcattcatactatgcttaccacggctactgggcaagcaacttcggtgcgttaaacccacacttcggt
acaatggaagatttccatacactgattgacgctgcccatgaaaaaggcatcaagatcatgcgttgacgtagtattaaaccacactggttatggctta
aaagatatcaacggagaagttccaatcctccagccggttacccaactgacgcagaacgcagcacatatagcagcctgcttcgccagggttca
aatgtcggctctgatgaggttgttggcgaattagctggcctacctgacttaaaaacagaagaccccgcagtccgccagacaatcatcgactggc
aaacagactggatcacgaaagctactacagctaaaggaaacacaattgactacttccgtgtcgacactgtgaagcacgttgaagacgcaacat
ggatggcattcaaaaatgacctcactgaaaaaatgccgacacacaaaatgatcggggaagcttggggagcaagtgccaataaccaacttggat
acctttgaaacaggtatgatggactcactgcttgacttcgacttcaaaggcattgcgcacgatttcgtgaacggcaagcttaaggcagcaaacgat
gccctgactgcccgcaacggtaaaattgacaacacagctactttaggttcattccttggaagccatgacgaagatggtttcctatttaaagaagga
aatgacaaaggcaagcttaaggttgctgcttcctgcaagcaacatcaaaaggccagccggtcatctattatggtgaagagcttggtcaaagtg
gagcaaacaactatccgcaatacgataaccgttatgacctggcatgggacaaagttgaaaacaacgacgtccttgagcactacactaaggtcct
gaacttcagaagcgctcattcagaagtgttcgctaaaggtgaacgcgcaacaattggcggttctgacgctgataaattcttacttttgctcgtaaa
aatggaaacgaagctgcttacgtcggcttgaacgttgctgacacagcaaaagacgtaacactgactgtttctgcaggtgcagtcgtaactgacc
actatgcagataaaacttatactgcttcagaagctggagaaatcacattgacgatcccggcaaaagctgatggcggtactgttttactaacggttg
aaggcggagaaatcacagctgctaaagcggcaagcgaaggcgacggcacagttgagccagtccctgcgaaccacatccgcattcactacaa
ccgtacagacaacaactatgaaaactacggtgcatggctgtggaacgatgtagcctcccttctgccaactggccgactggcgctacaatgtttg
aaaaaacagacagctacggtgcatacatcgacgtaccacttaaagagggcgctaagaacatcggcttcctcgttatggatgtaacaaaaggtga
tcagggtaaagacggcggcgacaaaggttttacgatctcatcacctgaaatgaacgaaatttggatcaagcaaggttctgacaaggtgtacactt
acgagccagttgatcttccggcgaacactgtccgcgtccactatgtacgtgacaacgcagactacgaaaacttcggtatctgaactggggcga
tgtaacagcaccttccgaaaactggcctacaggcgcagcgaaattcgatggtacagaccgttacggtgcgtatgtcgacattacgctaaaagaa

Figure 16EEEE ggcgcaaagaacattggaatgattgctcttaacactgcaaatggagagaaagacggcggagataaatccttcaaccttctggataaatataatcg
catttggattaaacaaggtgatgacaatgtctacgtttctccatactgggagcaggcaacaggaatcaccaatgcagaggtaatctctgaagata
cgattctattaggcttcacaatgactgacggcttaacacctgaatctttaaaaggaggtcttgtaattaaagattcaactggtgctgaagttgccatc
gaaagtgctgaaatcacaagcgcaacctctgtaaaagtaaaagcaacattcgatttagaaaagcttccattatccatcacatacgcaggcagaac
agtttcagcttcaactggctggagaatgcttgatgaaatgtacgcttatgatggaaacgaccttggtgcgacttacaaggacggagcagcgacg
cttaaattatgggctccgaaagcgagcaaggtaaccgctaacttctttgataaaaataatgccgctgaaaaaatcggcagcgtcgagttaacgaa
gggtgaaaaaggagtctggtcagctatggttgctcctggcgacctgaacgtaaccgatcttgaaggttattttaccagtatgatgtaacaaatga
cggtataactcgccaggtgttagatccttatgcaaaatcaatggcagcctttactgtgaatacagaaggcaatgctggtcctgacggggacactg
ttggcaaggcggcaattcaaaaagcttctcgagagtacttctag SEQ ID NO: 196
Met Leu Thr Asp Arg Phe Phe Asp Gly Asp Thr Ser Asn Asn Asp Pro Tyr Asn Gln Asn Tyr Asp
Ala Lys Asn Asp Arg Gly Thr Tyr Gln Gly Gly Asp Phe Lys Gly Ile Thr Gln Lys Leu Asp Tyr Leu
Asp Lys Leu Gly Val Asn Thr Ile Trp Ile Ser Pro Ile Val Glu Asn Ile Lys His Asp Val Arg Tyr Asp
Asn Ser Glu Gly His Ser Tyr Tyr Ala Tyr His Gly Tyr Trp Ala Ser Asn Phe Gly Ala Leu Asn Pro
His Phe Gly Thr Met Glu Asp Phe His Thr Leu Ile Asp Ala Ala His Glu Lys Gly Ile Lys Ile Met
Val Asp Val Val Leu Asn His Thr Gly Tyr Gly Leu Lys Asp Ile Asn Gly Glu Val Ser Asn Pro Pro
Ala Gly Tyr Pro Thr Asp Ala Glu Arg Ser Thr Tyr Ser Ser Leu Leu Arg Gln Gly Ser Asn Val Gly
Ser Asp Glu Val Val Gly Glu Leu Ala Gly Leu Pro Asp Leu Lys Thr Glu Asp Pro Ala Val Arg Gln
Thr Ile Ile Asp Trp Gln Thr Asp Trp Ile Thr Lys Ala Thr Thr Ala Lys Gly Asn Thr Ile Asp Tyr Phe
Arg Val Asp Thr Val Lys His Val Glu Asp Ala Thr Trp Met Ala Phe Lys Asn Asp Leu Thr Glu
Lys Met Pro Thr His Lys Met Ile Gly Glu Ala Trp Gly Ala Ser Ala Asn Asn Gln Leu Gly Tyr Leu
Glu Thr Gly Met Met Asp Ser Leu Leu Asp Phe Asp Phe Lys Gly Ile Ala His Asp Phe Val Asn Gly
Lys Leu Lys Ala Ala Asn Asp Ala Leu Thr Ala Arg Asn Gly Lys Ile Asp Asn Thr Ala Thr Leu Gly
Ser Phe Leu Gly Ser His Asp Glu Asp Gly Phe Leu Phe Lys Glu Gly Asn Asp Lys Gly Lys Leu
Lys Val Ala Ala Ser Leu Gln Ala Thr Ser Lys Gly Gln Pro Val Ile Tyr Tyr Gly Glu Glu Leu Gly
Gln Ser Gly Ala Asn Asn Tyr Pro Gln Tyr Asp Asn Arg Tyr Asp Leu Ala Trp Asp Lys Val Glu
Asn Asn Asp Val Leu Glu His Tyr Thr Lys Val Leu Asn Phe Arg Ser Ala His Ser Glu Val Phe Ala
Lys Gly Glu Arg Ala Thr Ile Gly Gly Ser Asp Ala Asp Lys Phe Leu Leu Phe Ala Arg Lys Asn Gly
Asn Glu Ala Ala Tyr Val Gly Leu Asn Val Ala Asp Thr Ala Lys Asp Val Thr Leu Thr Val Ser Ala
Gly Ala Val Val Thr Asp His Tyr Ala Asp Lys Thr Tyr Thr Ala Ser Glu Ala Gly Glu Ile Thr Leu
Thr Ile Pro Ala Lys Ala Asp Gly Gly Thr Val Leu Leu Thr Val Glu Gly Gly Glu Ile Thr Ala Ala
Lys Ala Ala Ser Glu Gly Asp Gly Thr Val Glu Pro Val Pro Ala Asn His Ile Arg Ile His Tyr Asn
Arg Thr Asp Asn Asn Tyr Glu Asn Tyr Gly Ala Trp Leu Trp Asn Asp Val Ala Ser Pro Ser Ala Asn
Trp Pro Thr Gly Ala Thr Met Phe Glu Lys Thr Asp Ser Tyr Gly Ala Tyr Ile Asp Val Pro Leu Lys
Glu Gly Ala Lys Asn Ile Gly Phe Leu Val Met Asp Val Thr Lys Gly Asp Gln Gly Lys Asp Gly Gly
Asp Lys Gly Phe Thr Ile Ser Ser Pro Glu Met Asn Glu Ile Trp Ile Lys Gln Gly Ser Asp Lys Val
Tyr Thr Tyr Glu Pro Val Asp Leu Pro Ala Asn Thr Val Arg Val His Tyr Val Arg Asp Asn Ala Asp
Tyr Glu Asn Phe Gly Ile Trp Asn Trp Gly Asp Val Thr Ala Pro Ser Glu Asn Trp Pro Thr Gly Ala
Ala Lys Phe Asp Gly Thr Asp Arg Tyr Gly Ala Tyr Val Asp Ile Thr Leu Lys Glu Gly Ala Lys Asn
Ile Gly Met Ile Ala Leu Asn Thr Ala Asn Gly Glu Lys Asp Gly Gly Asp Lys Ser Phe Asn Leu Leu
Asp Lys Tyr Asn Arg Ile Trp Ile Lys Gln Gly Asp Asp Asn Val Tyr Val Ser Pro Tyr Trp Glu Gln
Ala Thr Gly Ile Thr Asn Ala Glu Val Ile Ser Glu Asp Thr Ile Leu Leu Gly Phe Thr Met Thr Asp
Gly Leu Thr Pro Glu Ser Leu Lys Gly Gly Leu Val Ile Lys Asp Ser Thr Gly Ala Glu Val Ala Ile
Glu Ser Ala Glu Ile Thr Ser Ala Thr Ser Val Lys Val Lys Ala Thr Phe Asp Leu Glu Lys Leu Pro
Leu Ser Ile Thr Tyr Ala Gly Arg Thr Val Ser Ala Ser Thr Gly Trp Arg Met Leu Asp Glu Met Tyr
Ala Tyr Asp Gly Asn Asp Leu Gly Ala Thr Tyr Lys Asp Gly Ala Ala Thr Leu Lys Leu Trp Ala Pro
Lys Ala Ser Lys Val Thr Ala Asn Phe Phe Asp Lys Asn Asn Ala Ala Glu Lys Ile Gly Ser Val Glu
Leu Thr Lys Gly Glu Lys Gly Val Trp Ser Ala Met Val Ala Pro Gly Asp Leu Asn Val Thr Asp Leu
Glu Gly Tyr Phe Tyr Gln Tyr Asp Val Thr Asn Asp Gly Ile Thr Arg Gln Val Leu Asp Pro Tyr Ala Lys Ser Met Ala Ala Phe Thr Val Asn Thr Glu Gly Asn Ala Gly Pro Asp Gly Asp Thr Val Gly Lys
Ala Ala Ile Gln Lys Ala Ser Arg Glu Tyr Phe SEQ ID NO: 197
atgaaaccgtcaaaattcgtttttctctctgctgccatcgcttgcagcctctccagtaccgccaatgctgacgccatttgcatgcatttaactggaag
tactccgacgtcacgcaaaacgcctcgcaaatcgcggcggcgggttataaaaaagtgctgatttcgccagcactgaaatcgagtggcaatgaa
tggtgggcacgttatcaaccgcaagatctgcgcgtgatcgattccccacttggcaacaaaagtgacttaaaatccatgattgatgctctgaaggc
ggtcggcgttgatgtgtatgccgatgtggtgcttaaccatatggccaatgaaacatggaagcgtgaagacttaaattaccctggcagtgaagtgc
tgcaacaatacgcagctaacaccagttattatgcggaccaaacgcttttggcaatttaacggaaaacctattctctggctttgacttccacccaga
aggctgtattagcgattggaatgatgccggcaatgttcagtactggcgtctttgtggcggtgctggtgaccgagggctgccagacttagatccga
acaactgggtggtgtcacagcaacgtttgtatttgaatgcgctaaaaggtttaggtgtgaaaggcttccgcattgatgcggttaaacacatgagcc
aatatcaaatcgaccagattttcactgcagagattaccgccggaatgcacgtgtttggtgaagtgatcaccagtggtggcaaaggcgactccag
ctatgagaacttcttagcgccttatctcaacgccaccaaccattcggcttacgatttcccactgtttgcctctattcgcaacgccttctcctacagcgg
tggcatgaacatgcttcatgatccacaagcctatggccaagggcttgaaaacgcacgttcaattaccttaccatcacgcacgacatcccaacga
acgacggtttccgttatcaaatcatggatccgaaagatgaagagctggcttacgcttatatcctcggtaaagatggcggcacacctctgatttaca
gcgacaacttacctgataacgaagatcgtgataatcgccgtgggaaggtgtttggaaccgtgacctgatgaagaacatgttgcgcttccataac
caaatgcaagggcaagagatgacgatgctgtacagcgaccaatgtctactgatgtttaagcgcggtaaacaagggggtggtcggcattaataat
gcggtgaagagcgttctcataccgttgacacctatcagcatgagttcaactggtatcagccttacacagatacactcactggcgtgactgaaacc
gtgagttcgcgttaccacaccttccgaattccagctcgcagcgcgcgcatgtacatgctctaa SEQ ID NO: 198
Met Lys Pro Ser Lys Phe Val Phe Leu Ser Ala Ala Ile Ala Cys Ser Leu Ser Ser Thr Ala Asn Ala
Asp Ala Ile Leu His Ala Phe Asn Trp Lys Tyr Ser Asp Val Thr Gln Asn Ala Ser Gln Ile Ala Ala
Ala Gly Tyr Lys Lys Val Leu Ile Ser Pro Ala Leu Lys Ser Ser Gly Asn Glu Trp Trp Ala Arg Tyr
Gln Pro Gln Asp Leu Arg Val Ile Asp Ser Pro Leu Gly Asn Lys Ser Asp Leu Lys Ser Met Ile Asp
Ala Leu Lys Ala Val Gly Val Asp Val Tyr Ala Asp Val Val Leu Asn His Met Ala Asn Glu Thr Trp
Lys Arg Glu Asp Leu Asn Tyr Pro Gly Ser Glu Val Leu Gln Gln Tyr Ala Ala Asn Thr Ser Tyr Tyr
Ala Asp Gln Thr Leu Phe Gly Asn Leu Thr Glu Asn Leu Phe Ser Gly Phe Asp Phe His Pro Glu
Gly Cys Ile Ser Asp Trp Asn Asp Ala Gly Asn Val Gln Tyr Trp Arg Leu Cys Gly Gly Ala Gly Asp
Arg Gly Leu Pro Asp Leu Asp Pro Asn Asn Trp Val Val Ser Gln Gln Arg Leu Tyr Leu Asn Ala
Leu Lys Gly Leu Gly Val Lys Gly Phe Arg Ile Asp Ala Val Lys His Met Ser Gln Tyr Gln Ile Asp
Gln Ile Phe Thr Ala Glu Ile Thr Ala Gly Met His Val Phe Gly Glu Val Ile Thr Ser Gly Gly Lys Gly
Asp Ser Ser Tyr Glu Asn Phe Leu Ala Pro Tyr Leu Asn Ala Thr Asn His Ser Ala Tyr Asp Phe Pro
Leu Phe Ala Ser Ile Arg Asn Ala Phe Ser Tyr Ser Gly Gly Met Asn Met Leu His Asp Pro Gln Ala
Tyr Gly Gln Gly Leu Glu Asn Ala Arg Ser Ile Thr Phe Thr Ile Thr His Asp Ile Pro Thr Asn Asp
Gly Phe Arg Tyr Gln Ile Met Asp Pro Lys Asp Glu Glu Leu Ala Tyr Ala Tyr Ile Leu Gly Lys Asp
Gly Gly Thr Pro Leu Ile Tyr Ser Asp Asn Leu Pro Asp Asn Glu Asp Arg Asp Asn Arg Arg Trp
Glu Gly Val Trp Asn Arg Asp Leu Met Lys Asn Met Leu Arg Phe His Asn Gln Met Gln Gly Gln
Glu Met Thr Met Leu Tyr Ser Asp Gln Cys Leu Leu Met Phe Lys Arg Gly Lys Gln Gly Val Val
Gly Ile Asn Lys Cys Gly Glu Glu Arg Ser His Thr Val Asp Thr Tyr Gln His Glu Phe Asn Trp Tyr
Gln Pro Tyr Thr Asp Thr Leu Thr Gly Val Thr Glu Thr Val Ser Ser Arg Tyr His Thr Phe Arg Ile
Pro Ala Arg Ser Ala Arg Met Tyr Met Leu SEQ ID NO: 199
gtgagtttgaccaaaaaggctcagtacgaaccaaatacggcaccaaggctcagtacatctctgcaatcaatgccgcgcacaacaacaatatcca
aatttacggcgatgttgtgtttaaccaccgaggtggtgctgatgggaagtcgtgggtcgataccaagcgcgttgattgggacaaccgcaatattg
aactggggcgacaaatggattgaagcttgggttgagtttaattttcctggccgcaacgacaaatactcgaacttccattggacttggtatcactttgac
ggtgttgactgggatgacgccggcaaagaaaaagcgatctttaaattcaaaggcgaaggaaaagcatgggattgggaagtcagctctgaaaa
aggcaattacgactacctaa

Figure 16GGGG

SEQ ID NO: 200
Val Ser Leu Thr Lys Lys Ala Gln Tyr Glu Pro Asn Thr Ala Pro Arg Leu Ser Thr Ser Leu Gln Ser
Met Pro Arg Thr Thr Thr Ile Ser Lys Phe Thr Ala Met Leu Cys Leu Thr Thr Glu Val Val Leu Met
Gly Ser Arg Gly Ser Ile Pro Ser Ala Leu Ile Gly Thr Thr Ala Ile Leu Asn Trp Ala Thr Asn Gly Leu
Lys Leu Gly Leu Ser Leu Ile Phe Leu Ala Ala Thr Thr Asn Thr Arg Thr Ser Ile Gly Leu Gly Ile
Thr Leu Thr Val Leu Thr Gly Met Thr Pro Ala Lys Lys Lys Arg Ser Leu Asn Ser Lys Ala Lys Glu
Lys His Gly Ile Gly Lys Ser Ala Leu Lys Lys Ala Ile Thr Thr Thr

SEQ ID NO: 201
atgacagccaaggctgatgacttacgcatttaccagatcatggtggaaagctttgtggatggcgataaacaggtcggccatggcaccggctacg
gtaccagccatcacaaaggcgatctgcaagggatcattgactcgctggattacattcaatcgctgggcgtcaatgccatttggctaacgccgattt
ttgaatctattccggtggagggacaagaccattgggcggacaggcttgatgctacaggctactttgccagtgactatttcaagatagaccctcgct
ttggcacgttagaacaagcccgtgagctggtggaaaaggcacacgcgaaaggcttgtatgtcttctttgatggagtatttggtcaccataaaggc
aatgtggtgccatcaccacaaggtagactgcctgtcggtgaaaataacccggtcagctacccagagagcctggcgttttacgaagaagtcgcc
agttactgggtgaaagagttaaagattgatggctggcgtctggatcaagcctatcaagtgccgaccgatgcatggaaagcgatccgtcagagc
gttgatgaagcgtcacagtccgtaacttatgtgaataacaaaggggaaaccgtccatcctttgggttacatggtggctgaaatttggaataacgaa
cgttacatcacagaaaccggttacggcaaagaaggcgatccggcgttgtgctcggcttttgattttccgatgcgtttccgagtggtcgaaacctttt
gcggttaacgaaagtggtgtcagccgaaaaggcggcgaatggttgaatgacggcatgtcactgcacagtcagtatccggatcatgccaagcct
aatttaatgttgggcaaccatgatgtggtgcgctttggggatctgctgcaacgtggcggtattgcgtcaccagaacaaccgcaatactggcagcg
tcataaagcggcgatgtctttcttagcagcgtataccggcccaattaccttgtattacggtgaagaaattggcgatcaggttgacggctttgctaaa
aaaatcaaagaagattgtgccgttattggtttgtgtgatgaccacgtggcgcgcaccagtgcgaagattgatggcgtgacggcgtcactgaatg
cacagcagtctgaactcaaagtatatgtctcttcattgatgacattacgtcagcaacatcctgcgttatcacaaggggaacgtactaatgtgatggc
gacagagacagtatacgtagaccataaacaggcagacaatgaagccctgttgtacatggtgagtacgactgataacgcggagtcagtcacctt
gaagggcaaagcgattggttcacaaggtgtgctgattgatttgttaacgaacgagcgttttatgcccaataatggggagtatgccattccattaac
gggctttggcgcacgattcctcaagattgacactccgacagcggcgggtgtgatggcgcaatctgctgcctcggtatcgctagtaggtgaagg
gatcatggcccaatgtgatacccccaaccgttgaaggcaccggtccggtagcagaaaccttgtacgtggttggcgattttgccgatgctggttgga
agcaaaagccgcagcgcgcgtatcaatacaaaggcaagcacaatggcagcaacttgtatcaagtggttgtcgatgaaaaagcgggcgcctac
aagatgcaatacgccacgaaagattggagcccacagtttactgcagacggtatggcattgaagccgggtaccgcaaagtcgctcatagcgggt
ggctacggtaaagacaccgccgtgacgttgccggaatccggtaagtatgtgtggagcttaacattcagtgatcttggcgagccggagcaaatc
atggtgtctaagtgtcagtaa SEQ ID NO: 202
Met Thr Ala Lys Ala Asp Asp Leu Arg Ile Tyr Gln Ile Met Val Glu Ser Phe Val Asp Gly Asp Lys
Gln Val Gly His Gly Thr Gly Tyr Gly Thr Ser His His Lys Gly Asp Leu Gln Gly Ile Ile Asp Ser
Leu Asp Tyr Ile Gln Ser Leu Gly Val Asn Ala Ile Trp Leu Thr Pro Ile Phe Glu Ser Ile Pro Val Glu
Gly Gln Asp His Trp Ala Asp Arg Leu Asp Ala Thr Gly Tyr Phe Ala Ser Asp Tyr Phe Lys Ile Asp
Pro Arg Phe Gly Thr Leu Glu Gln Ala Arg Glu Leu Val Glu Lys Ala His Ala Lys Gly Leu Tyr Val
Phe Phe Asp Gly Val Phe Gly His His Lys Gly Asn Val Val Pro Ser Pro Gln Gly Arg Leu Pro Val
Gly Glu Asn Asn Pro Val Ser Tyr Pro Glu Ser Leu Ala Phe Tyr Glu Glu Val Ala Ser Tyr Trp Val
Lys Glu Leu Lys Ile Asp Gly Trp Arg Leu Asp Gln Ala Tyr Gln Val Pro Thr Asp Ala Trp Lys Ala
Ile Arg Gln Ser Val Asp Glu Ala Ser Gln Ser Val Thr Tyr Val Asn Asn Lys Gly Glu Thr Val His
Pro Leu Gly Tyr Met Val Ala Glu Ile Trp Asn Asn Glu Arg Tyr Ile Thr Glu Thr Gly Tyr Gly Lys
Glu Gly Asp Pro Ala Leu Cys Ser Ala Phe Asp Phe Pro Met Arg Phe Arg Val Val Glu Thr Phe Ala
Val Asn Glu Ser Gly Val Ser Arg Lys Gly Gly Glu Trp Leu Asn Asp Gly Met Ser Leu His Ser Gln
Tyr Pro Asp His Ala Lys Pro Asn Leu Met Leu Gly Asn His Asp Val Val Arg Phe Gly Asp Leu
Leu Gln Arg Gly Gly Ile Ala Ser Pro Glu Gln Pro Gln Tyr Trp Gln Arg His Lys Ala Ala Met Ser
Phe Leu Ala Ala Tyr Thr Gly Pro Ile Thr Leu Tyr Tyr Gly Glu Glu Ile Gly Asp Gln Val Asp Gly
Phe Ala Lys Lys Ile Lys Glu Asp Cys Ala Val Ile Gly Leu Cys Asp Asp His Val Ala Arg Thr Ser
Ala Lys Ile Asp Gly Val Thr Ala Ser Leu Asn Ala Gln Gln Ser Glu Leu Lys Val Tyr Val Ser Ser
Leu Met Thr Leu Arg Gln Gln His Pro Ala Leu Ser Gln Gly Glu Arg Thr Asn Val Met Ala Thr Glu

Figure 16HHHH

Thr Val Tyr Val Asp His Lys Gln Ala Asp Asn Glu Ala Leu Leu Tyr Met Val Ser Thr Thr Asp Asn
Ala Glu Ser Val Thr Leu Lys Gly Lys Ala Ile Gly Ser Gln Gly Val Leu Ile Asp Leu Leu Thr Asn
Glu Arg Phe Met Pro Asn Asn Gly Glu Tyr Ala Ile Pro Leu Thr Gly Phe Gly Ala Arg Phe Leu Lys
Ile Asp Thr Pro Thr Ala Ala Gly Val Met Ala Gln Ser Ala Ala Ser Val Ser Leu Val Gly Glu Gly Ile
Met Ala Gln Cys Asp Thr Pro Thr Val Glu Gly Thr Gly Pro Val Ala Glu Thr Leu Tyr Val Val Gly
Asp Phe Ala Asp Ala Gly Trp Lys Gln Lys Pro Gln Arg Ala Tyr Gln Tyr Lys Gly Lys His Asn Gly
Ser Asn Leu Tyr Gln Val Val Val Asp Glu Lys Ala Gly Ala Tyr Lys Met Gln Tyr Ala Thr Lys Asp
Trp Ser Pro Gln Phe Thr Ala Asp Gly Met Ala Leu Lys Pro Gly Thr Ala Lys Ser Leu Ile Ala Gly
Gly Tyr Gly Lys Asp Thr Ala Val Thr Leu Pro Glu Ser Gly Lys Tyr Val Trp Ser Leu Thr Phe Ser
Asp Leu Gly Glu Pro Glu Gln Ile

SEQ ID NO: 203
atgaagatgaagtcccggggcgtggttgttaggtagtgcagtggccatggcgttggcctcttcggcagccaatgccggtgtcatggttcacctgtt
ccagtggaagtacaatgacatcgccaacgagtgcgaaaaggtgctcggtcccaaagggtatgaagcagtgcagatcacgccgcctgctgaa
cacctgcaaggctcctcctggtgggtggtctatcagcccgtcagctacaagaacttcacttctctgggcggtaacgaggccgaactcaaaagca
tgatcgcccgttgcaaggccgccggggtcaagatttacgccgatgcggtattcaaccagctggctggtggatcaggcgtcggtacaggtggta
gcagctacaatgccggcagcttcagctatccccaatttggctacaacgatttccatcacgctgggagcctcaccaactatgccgaccgcaacaa
tgtgcaaaacggtgccctgctggggctgccggatctggataccggctctgcctatgtgcaggatcagctggctacctatatgaagaccctgagt
ggctggggtgtggcaggttttcgtcttgatgcagcaaagcatatgagcgttgccgatctctcggccatcgtcagcaaggcgggcaatcctttgt
ctactccgaggtgattggtgccacgggtgaaccaatccagccgggcgaatataccggcattggtgccgtgaccgaatttaaatacggcaccga
tctggcctccaacttcaaggggcagatcaagaatctcaagagcatgggcgagagctggggtctgcttgcgtcgaacaaggctgaagtctttgtg
gtcaaccatgaccgtgagcggggacatggcggtggcggtatgctgacctacaaggatggtgccctctacaatctggccaacatcttcatgctg
gcctggccctatggcgcctatccccaggtgatgtccggctatgatttcggcaccaataccgatattggtgggccgagcgctacccttgttcttcc
ggctctagctggaactgcgaacaccgctggagcaacatcgccaacatggtctcgttccacaatgccgcccaaggcacgtccatgaccaactg
gtgggataatggtaataaccagatcgcctttggtcgcggcgccaaggcctttgtggtgatcaacaatgaatcttccactctgagcaagagcctgc
agacgggtctgccagccggggagtactgcaacattctggccggtgatgccctgtgcagcggcagcaccatcaaggtggatgccagcggtat
ggccaccttcaacgtggcagggatgaaggcggcagcgatccatatcaatgccaagcccgatagcaccagcagtggcagctcaggctcttcct
ctggctcttcttcctctgccaccagtaacaagtttgccagcatgaatctgcggggcaccaacaatggctgggccagcaccgccatgacagtgga
tgccaaccgtgtctggtcggccggatgtcacctttaccgggggccgcggatgccaatggtgcccagcgcttcaagtttgatgtctatggcaactgg
acagagagctatggcgatacacaagccgatggcattgccgacaaggggagcgccaaggacatctatttcaatggtgtgggcaagtatcgtgtc
tcgctcaaggagagcgacatgagctacaccctgacccagctctccagcaatcaggcaccggtggcggccatcaccccaagacactctccgt
caagctgggtgactcagtggtgttcgatgcctccggctccaccgatgatgtgggtgtcactggctacagctggtctaccggtggcagtgccaag
accgaaactgtgctgtttgatgctctgggtaccaagaccattaccgtgacagtggccgatgccgatggcttgacctccaaggccagtgccaccg
tcaccgtcaccgatggcagcgtggcttataacagcaactttgccagcctgaacttccgtggcactccaacagttggggcgcggcagccatga
cgctggtggcagacaacacctgggaggcaacggtcaacttcgatggtcaggccaatcagcgcttcaagttcgatatcaagggtgactggagc
cagaactatggtgatagcaacaaggatggggtggccgaacgtaccggtgccgatatttacaccactgtgaccggtcaatataaggtgcaattta
acgactccactttgaagtacaccctgaccaagctggccgatagcagcgccaccagctatagcgcgaactttgccagcctctacctgcgtggca
ccccgaacagctggggcaccaccgccatgaagctggtggccaataacagctggcaggccgaggtgaccttcaccggcaagggcgatgcca
ctggtgcccaacgcttcaagttcgacgtcaagggtgactggagccagaactacggtgacagcaacatggacgggactgccgaacggactgg
tggcgatatcaccagtgccgtggtgggcacctatctggtgacctttaatgacagcacactgaaatacaccctgaccgccaaataa SEQ ID NO: 204
Met Lys Met Lys Ser Arg Ala Trp Leu Leu Gly Ser Ala Val Ala Met Ala Leu Ala Ser Ser Ala Ala
Asn Ala Gly Val Met Val His Leu Phe Gln Trp Lys Tyr Asn Asp Ile Ala Asn Glu Cys Glu Lys Val
Leu Gly Pro Lys Gly Tyr Glu Ala Val Gln Ile Thr Pro Pro Ala Glu His Leu Gln Gly Ser Ser Trp
Trp Val Val Tyr Gln Pro Val Ser Tyr Lys Asn Phe Thr Ser Leu Gly Gly Asn Glu Ala Glu Leu Lys
Ser Met Ile Ala Arg Cys Lys Ala Ala Gly Val Lys Ile Tyr Ala Asp Ala Val Phe Asn Gln Leu Ala
Gly Gly Ser Gly Val Gly Thr Gly Gly Ser Ser Tyr Asn Ala Gly Ser Phe Ser Tyr Pro Gln Phe Gly
Tyr Asn Asp Phe His His Ala Gly Ser Leu Thr Asn Tyr Ala Asp Arg Asn Asn Val Gln Asn Gly
Ala Leu Leu Gly Leu Pro Asp Leu Asp Thr Gly Ser Ala Tyr Val Gln Asp Gln Leu Ala Thr Tyr Met

Figure 16IIII

Lys Thr Leu Ser Gly Trp Gly Val Ala Gly Phe Arg Leu Asp Ala Ala Lys His Met Ser Val Ala Asp
Leu Ser Ala Ile Val Ser Lys Ala Gly Asn Pro Phe Val Tyr Ser Glu Val Ile Gly Ala Thr Gly Glu Pro
Ile Gln Pro Gly Glu Tyr Thr Gly Ile Gly Ala Val Thr Glu Phe Lys Tyr Gly Thr Asp Leu Ala Ser
Asn Phe Lys Gly Gln Ile Lys Asn Leu Lys Ser Met Gly Glu Ser Trp Gly Leu Leu Ala Ser Asn Lys
Ala Glu Val Phe Val Val Asn His Asp Arg Glu Arg Gly His Gly Gly Gly Gly Met Leu Thr Tyr Lys
Asp Gly Ala Leu Tyr Asn Leu Ala Asn Ile Phe Met Leu Ala Trp Pro Tyr Gly Ala Tyr Pro Gln Val
Met Ser Gly Tyr Asp Phe Gly Thr Asn Thr Asp Ile Gly Gly Pro Ser Ala Thr Pro Cys Ser Ser Gly
Ser Ser Trp Asn Cys Glu His Arg Trp Ser Asn Ile Ala Asn Met Val Ser Phe His Asn Ala Ala Gln
Gly Thr Ser Met Thr Asn Trp Trp Asp Asn Gly Asn Asn Gln Ile Ala Phe Gly Arg Gly Ala Lys Ala
Phe Val Val Ile Asn Asn Glu Ser Ser Thr Leu Ser Lys Ser Leu Gln Thr Gly Leu Pro Ala Gly Glu
Tyr Cys Asn Ile Leu Ala Gly Asp Ala Leu Cys Ser Gly Ser Thr Ile Lys Val Asp Ala Ser Gly Met
Ala Thr Phe Asn Val Ala Gly Met Lys Ala Ala Ala Ile His Ile Asn Ala Lys Pro Asp Ser Thr Ser
Ser Gly Ser Ser Gly Ser Ser Ser Gly Ser Ser Ser Ser Ala Thr Ser Asn Lys Phe Ala Ser Met Asn Leu
Arg Gly Thr Asn Asn Gly Trp Ala Ser Thr Ala Met Thr Val Asp Ala Asn Arg Val Trp Ser Ala Asp
Val Thr Phe Thr Gly Ala Ala Asp Ala Asn Gly Ala Gln Arg Phe Lys Phe Asp Val Tyr Gly Asn Trp
Thr Glu Ser Tyr Gly Asp Thr Gln Ala Asp Gly Ile Ala Asp Lys Gly Ser Ala Lys Asp Ile Tyr Phe
Asn Gly Val Gly Lys Tyr Arg Val Ser Leu Lys Glu Ser Asp Met Ser Tyr Thr Leu Thr Gln Leu Ser
Ser Asn Gln Ala Pro Val Ala Ala Ile Thr Pro Lys Thr Leu Ser Val Lys Leu Gly Asp Ser Val Val
Phe Asp Ala Ser Gly Ser Thr Asp Asp Val Gly Val Thr Gly Tyr Ser Trp Ser Thr Gly Gly Ser Ala
Lys Thr Glu Thr Val Leu Phe Asp Ala Leu Gly Thr Lys Thr Ile Thr Val Thr Val Ala Asp Ala Asp
Gly Leu Thr Ser Lys Ala Ser Ala Thr Val Thr Val Thr Asp Gly Ser Val Ala Tyr Asn Ser Asn Phe
Ala Ser Leu Asn Phe Arg Gly Thr Pro Asn Ser Trp Gly Ala Ala Ala Met Thr Leu Val Ala Asp Asn
Thr Trp Glu Ala Thr Val Asn Phe Asp Gly Gln Ala Asn Gln Arg Phe Lys Phe Asp Ile Lys Gly Asp
Trp Ser Gln Asn Tyr Gly Asp Ser Asn Lys Asp Gly Val Ala Glu Arg Thr Gly Ala Asp Ile Tyr Thr
Thr Val Thr Gly Gln Tyr Lys Val Gln Phe Asn Asp Ser Thr Leu Lys Tyr Thr Leu Thr Lys Leu Ala
Asp Ser Ser Ala Thr Ser Tyr Ser Ala Asn Phe Ala Ser Leu Tyr Leu Arg Gly Thr Pro Asn Ser Trp
Gly Thr Thr Ala Met Lys Leu Val Ala Asn Asn Ser Trp Gln Ala Glu Val Thr Phe Thr Gly Lys Gly
Asp Ala Thr Gly Ala Gln Arg Phe Lys Phe Asp Val Lys Gly Asp Trp Ser Gln Asn Tyr Gly Asp Ser
Asn Met Asp Gly Thr Ala Glu Arg Thr Gly Gly Asp Ile Thr Ser Ala Val Val Gly Thr Tyr Leu Val
Thr Phe Asn Asp Ser Thr Leu Lys Tyr Thr Leu Thr Ala Lys

SEQ ID NO: 205
atgtaccgcgtaatacctattattttgattatgagtatgattgtagcttgtgagtctccaaagaaaaaaacaaccgaaaccgctcaaccttcaacaaa
tgccgaaaaaccctttgtttgggaggctgccaatgtatatttttgttaactgaccgttttaacaacggtaacccaaacaatgacatcaatttaatag
gactaaagaatcaggaaaactccgcaattttatgggaggcgatatcaagggcatcacccaaaaaataaatgaggggtatttagtaaactaggc
gttaatgccatctggcttaccccggttgttgaacaaatacatggcagtgttgatgaaggtaccggcaatacctatgcctttcatggctattgggcca
aagattggacaaacttagacccaaattttggcacaaaagaagaccttgccgaactggtggcaactgcccatgcaaaaggcatcaggatactttta
gatgtggtaataaaccacaccggcccggtaaccgaccaagacccggtttggggagaagattgggtacgtacaggcccgcagtgtacctatga
taattacaccaataccaccagttgcacgctggtagccaatttacctgatatacttacagaaagtaatgaaaatgtggccttaccaaccttttgttaga
taaatggaaagccgaaggcagattagagcaagaactaaaagaacttgacgattttttttcccgcacaggccacccacgcgcacccgctttac
attattaaatggcttaccgattacatccgagaatttggggtagatgggtttagggttgataccgtaaaacataccgaagaaacggtttgggccgag
ttgtatgatgaagccgtaattgcttttgccgaatataaaaaagccaacccagacaaggtattggacgataatgaattttatatggtaggcgaagtgt
acaactacggtatttccggcggaaggttctatgatttcggcgataaaaaggtggactattttgaccacggatttaaaagcctcatcaatttgaaatg
aaatatgatgccaattttacctacgatacactttttaggaagtacgataccccttttgcataccaaacttaaaggcagaagtgtgctcaactacctctca
tctcacgacgatggaagtccatttgataaaatgcggcaaaaaccatacgagtcggctacaaaattactgctcactccgggcgcatcccaaattat
tacggtgacgaaaccgccagaagccttaacatagaaggcgcacagggagatgctacgcttcgttcgtttatgaattgggaagagctcgcagaa
gaccctgccaagcaaaaaatacttcagcattggcaaaaactgggcagtttcaggaacaaccaccccgcagttggtgccggaaggcacaaaac
ccttggcaaaaagccgttttacaccctttagcagggtttatcaaaaaaatggttttattgacaaagttgtggtagcattagatgccctaaaggccaaa
aacaaattaccgttaatggtgtttttgatgacggtacaaaacttgtagatgcctattcaggcaaagaaacctcagttaaaaatggtatcgtttcacttt
cttctgaatttgatattgttttgttagaacaaaaataa

Figure 16JJJJ

SEQ ID NO: 206
Met Tyr Arg Val Ile Pro Ile Ile Leu Ile Met Ser Met Ile Val Ala Cys Glu Ser Pro Lys Lys Lys Thr
Thr Glu Thr Ala Gln Pro Ser Thr Asn Ala Glu Lys Pro Phe Val Trp Glu Ala Ala Asn Val Tyr Phe
Leu Leu Thr Asp Arg Phe Asn Asn Gly Asn Pro Asn Asn Asp Ile Asn Phe Asn Arg Thr Lys Glu
Ser Gly Lys Leu Arg Asn Phe Met Gly Gly Asp Ile Lys Gly Ile Thr Gln Lys Ile Asn Glu Gly Tyr
Phe Ser Lys Leu Gly Val Asn Ala Ile Trp Leu Thr Pro Val Val Glu Gln Ile His Gly Ser Val Asp
Glu Gly Thr Gly Asn Thr Tyr Ala Phe His Gly Tyr Trp Ala Lys Asp Trp Thr Asn Leu Asp Pro Asn
Phe Gly Thr Lys Glu Asp Leu Ala Glu Leu Val Ala Thr Ala His Ala Lys Gly Ile Arg Ile Leu Leu
Asp Val Val Ile Asn His Thr Gly Pro Val Thr Asp Gln Asp Pro Val Trp Gly Glu Asp Trp Val Arg
Thr Gly Pro Gln Cys Thr Tyr Asp Asn Tyr Thr Asn Thr Thr Ser Cys Thr Leu Val Ala Asn Leu Pro
Asp Ile Leu Thr Glu Ser Asn Glu Asn Val Ala Leu Pro Thr Phe Leu Leu Asp Lys Trp Lys Ala Glu
Gly Arg Leu Glu Gln Glu Leu Lys Glu Leu Asp Asp Phe Phe Ser Arg Thr Gly His Pro Arg Ala Pro
Arg Phe Tyr Ile Ile Lys Trp Leu Thr Asp Tyr Ile Arg Glu Phe Gly Val Asp Gly Phe Arg Val Asp
Thr Val Lys His Thr Glu Glu Thr Val Trp Ala Glu Leu Tyr Asp Glu Ala Val Ile Ala Phe Ala Glu
Tyr Lys Lys Ala Asn Pro Asp Lys Val Leu Asp Asp Asn Glu Phe Tyr Met Val Gly Glu Val Tyr
Asn Tyr Gly Ile Ser Gly Gly Arg Phe Tyr Asp Phe Gly Asp Lys Lys Val Asp Tyr Phe Asp His Gly
Phe Lys Ser Leu Ile Asn Phe Glu Met Lys Tyr Asp Ala Asn Phe Thr Tyr Asp Thr Leu Phe Arg Lys
Tyr Asp Thr Leu Leu His Thr Lys Leu Lys Gly Arg Ser Val Leu Asn Tyr Leu Ser Ser His Asp Asp
Gly Ser Pro Phe Asp Lys Met Arg Gln Lys Pro Tyr Glu Ser Ala Thr Lys Leu Leu Leu Thr Pro Gly
Ala Ser Gln Ile Tyr Tyr Gly Asp Glu Thr Ala Arg Ser Leu Asn Ile Glu Gly Ala Gln Gly Asp Ala
Thr Leu Arg Ser Phe Met Asn Trp Glu Glu Leu Ala Glu Asp Pro Ala Lys Gln Lys Ile Leu Gln His
Trp Gln Lys Leu Gly Ser Phe Arg Asn Asn His Pro Ala Val Gly Ala Gly Arg His Lys Thr Leu Gly
Lys Lys Pro Phe Tyr Thr Phe Ser Arg Val Tyr Gln Lys Asn Gly Phe Ile Asp Lys Val Val Val Ala
Leu Asp Ala Pro Lys Gly Gln Lys Gln Ile Thr Val Asn Gly Val Phe Asp Asp Gly Thr Lys Leu Val
Asp Ala Tyr Ser Gly Lys Glu Thr Ser Val Lys Asn Gly Ile Val Ser Leu Ser Ser Glu Phe Asp Ile
Val Leu Leu Glu Gln Lys

SEQ ID NO: 207
ctgtcgactgagcctttcgttttgggctcgagactgactctcagcccaccccgcagtagctccagacggagtagccgtaatagccgttggccgg
gtcgtgggcaggggcctcgaggtacacccacccgcttgagtccacccacttgtccacccagccgccgaggttgccggtgtactcgtggatgc
acgctcccgcgaacttcggaacgtagacccaccttccggctttgcttgaggcgaggttgatgtatgttatcagtcccggcttgcttccgtagccgt
ttctcacgaatatcagctcgtcgttgtcgtagtaaacgacgtcagtgcttcctccggccaggttgtcatgtatccagatgaggttcttgagcttatcct
tgttgagccactcctcgtagtcgcggtagaatattgtcggctggccctcgtaggtgaggatgaacgcgtaggctggatacttgttccagattatat
cggtgtcgtggtttgcaacgaaggttacggcctaaacgggtcgcggctgacgactgtgcccccgttcttgagggcctcgacgagtgcgggaa
tgttcttgttgtcaaaggccgcgtccatcttgtagtagagcgggaagtcgaagaccttggcgccgctcgagtaggcccagttgaggagtgcatc
aacgttggtgtcccagtactcgccaacggcccagccgccccaccagttgagccagtccttgacgacccacgctccgtggcccttcacgtagtc
aaagcgccaggcatcaacgccgatgctccttaggtaggcggcgtagctctcatcgctcgcccagagccagtgctggtcccagctcttctcgtg
ggctatgtctgggaagcctccaaatgtgccctcgtcacagcacttgacctcgttggggtggaagtcgaggtagttggcagtatatttgcccgagg
ccaccttttgagaagtccgtccaggtgtagtcccccaacgaacgggttccactcgaggtctccgcctgcgcggtggtttatgacgatgtccgctatg
acctttatgccgtaggcatgggccgtgtttatcatgttcacgagctcctgcttggagccaaagcgcgtctctaccgttcccttctggtcgtactcacc
gaggtcaaagaagtcgtaggggtcgtagcccatcgaataggcgccgcccatgcccttgctcgccggggggaatccaaatggcggatattcccg
cctcgtaccactccggtatcttgctcctgatggtgtcccaccagattcctccacctgggacgtcccagtagaaggcctgcattataacgccgccct
cttccagctcggagtacttggccataagttacctcctactagtagattaaaa SEQ ID NO: 208
Leu Ser Thr Glu Pro Phe Val Leu Gly Ser Arg Leu Thr Leu Ser Pro Pro Arg Ser Ser Ser Arg Arg
Ser Ser Arg Asn Ser Arg Trp Pro Gly Arg Gly Gln Gly Pro Arg Gly Thr Pro Thr Arg Leu Ser Pro
Pro Thr Cys Pro Pro Ser Arg Arg Gly Cys Arg Cys Thr Arg Gly Cys Thr Leu Pro Arg Thr Ser Glu
Arg Arg Pro Thr Phe Arg Leu Cys Leu Arg Arg Gly Cys Met Leu Ser Val Pro Ala Cys Phe Arg Ser Arg Phe Ser Arg Ile Ser Ala Arg Arg Cys Arg Ser Lys Arg Arg Gln Cys Phe Leu Arg Pro Gly
Cys His Val Ser Arg Gly Ser Ala Tyr Pro Cys Ala Thr Pro Arg Ser Arg Gly Arg Ile Leu Ser Ala
Gly Pro Arg Arg Gly Thr Arg Arg Leu Asp Thr Cys Ser Arg Leu Tyr Arg Cys Arg Gly Leu Gln
Arg Arg Leu Arg Pro Thr Gly Arg Gly Arg Leu Cys Pro Arg Ser Gly Pro Arg Arg Val Arg Glu
Cys Ser Cys Cys Gln Arg Pro Arg Pro Ser Cys Ser Arg Ala Gly Ser Arg Arg Pro Trp Arg Arg Ser
Ser Arg Pro Ser Gly Val His Gln Arg Trp Cys Pro Ser Thr Arg Gln Arg Pro Ser Arg Pro Thr Ser
Ala Ser Pro Arg Pro Thr Leu Arg Gly Pro Ser Arg Ser Gln Ser Ala Arg His Gln Arg Arg Cys Ser
Leu Gly Arg Arg Arg Ser Ser His Arg Ser Pro Arg Ala Ser Ala Gly Pro Ser Ser Ser Arg Gly Leu
Cys Leu Gly Ser Leu Gln Met Cys Pro Arg His Ser Thr Pro Arg Trp Gly Gly Ser Arg Gly Ser Trp
Gln Tyr Ile Cys Pro Arg Pro Pro Leu Arg Ser Pro Ser Arg Cys Ser Pro Gln Arg Thr Gly Ser Thr
Arg Gly Leu Arg Leu Arg Gly Gly Leu Arg Cys Pro Leu Pro Leu Cys Arg Arg His Gly Pro Cys
Leu Ser Cys Ser Arg Ala Pro Ala Trp Ser Gln Ser Ala Ser Leu Pro Phe Pro Ser Gly Arg Thr His
Arg Gly Gln Arg Ser Arg Arg Gly Arg Ser Pro Ser Asn Arg Arg Arg Pro Cys Pro Cys Ser Pro Gly
Glu Ser Lys Trp Arg Ile Phe Pro Pro Arg Thr Thr Pro Val Ser Cys Ser Trp Cys Pro Thr Arg Phe
Leu His Leu Gly Arg Pro Ser Arg Arg Pro Ala Leu Arg Arg Pro Leu Pro Ala Arg Ser Thr Trp Pro
Val Thr Ser Tyr Ile Lys SEQ ID NO: 209
atgattcagcccatgcactctcgggaacaggcctgccgtctcattccggcactgatcatgacatttgcactggcactgccgttgcaaattcgtgccg
atgtcaccctgcatgctttcaactggagctatgccgatgtcgctgatcgggccgttgacatcgctgcagcagggtacagtgccgtgctggtggccc
cgccacttcgatccgaaggcacggcctggtgggcgcgataccagcccaggatctccgccttatcgaccatccgctgggcaatacacatgacttc
gtcaacatgatcgatgctctcgatgatgtgggtgtgggcgtgtacgccgacatcgtgctcaaccacatggccaatgaggctgcacaaaggcctga
cctgaactaccctggtcaggcagtgcttgacgaatatgcttccgatcccggtcatttcgagggcttgaggctgttcggtaatctgagcttcaatttcct
gtcggaacatgatttcggacccgcccagtgcattcaggattacagcgatgtgtttcaggtccagaactggcggctgtgcggaccgccgccggacc
cggggcctgcccgacctggtcgccaatgactgggtgatctctcaacagcgccagtatctggaagccatcaaggcgctgggtgtggctggcatgcg
catcgacgcggtcaagcatatgcccatgagccatatcaatgccgttctcaccccgagatccggtcgggcttgcatgtgtttggcgaagtcatcacc
tccggtggggctggtgatacatcctacgaccgtttctggccccttacctggcacaaagcgaccatggtgcctatgactttcattgtttgaaaccatt
cgccgtgctttcggcttcggtggcagcatgagtgaactggtcgatcctgctgcctacggtcaggccctgccaccggaccgcgccatcaccttcgtc
atcacgcacgatattccgaacaatgacggatttcgctaccagatactcgaccccgtcgatgaatcactggcctacgcctacattctgggccgcgatg
gcggtgtcccgcttctgtattccgacaacaatgaaagcggcgatggccgctggatcgatgcctggcaacgtccggatctggttgcaatggtcggct
tccacaatgcagtccacggtcaggacatggccgtgctttcacatgacgactgccacctgctgtttcggcgcggcagcctcgggattgtcggcatca
acaagtgcggccatgcactcagctcctgggtcaacatgaaccagagcgtactgtggtggtacgcggactacacagacgtgctcgacagcaacag
cgttgtcaacatccagtcatcctggcacgagttcatccttcccgcccgccaggcacgcctgtggttgcga SEQ ID NO: 210
MIQPMHSREQACRLIPALIMTFALALPLQIRADVTLHAFNWSYADVADRAVDIAAAGYSA
VLVAPPLRSEGTAWWARYQPQDLRLIDHPLGNTHDFVNMIDALDDVGVGVYADIVLNHM
ANEAAQRPDLNYPGQAVLDEYASDPGHFEGLRLFGNLSFNFLSEHDFGPAQCIQDYSDVF
QVQNWRLCGPPPDPGLPDLVANDWVISQQRQYLEAIKALGVAGMRIDAVKHMPMSHINA
VLTPEIRSGLHVFGEVITSGGAGDTSYDRFLAPYLAQSDHGAYDFPLFETIRRAFGFGGSMS
ELVDPAAYGQALPPDRAITFVITHDIPNNDGFRYQILDPVDESLAYAYILGRDGGVPLLYSD
NNESGDGRWIDAWQRPDLVAMVGFHNAVHGQDMAVLSHDDCHLLFRRGSLGIVGINKC
GHALSSWVNMNQSVLWWYADYTDVLDSNSVVNIQSSWHEFILPARQARLWLR SEQ ID NO: 211
GTGTTTCGTTCTGACACAGTTTCGCGTACCTGCATGTATGGTGCGCTGCGTAATGCCTA
CCAACCCGATCGGGTGTTTACTGGAGTCACGGTGCGGACATGCAACTTAAAAAAGCAT
GCTCATCGCCAGGCGCTGTTGTTCATCGTGACGCGGTGCCTGTGCCTGAAATCCAGGC
AGACCCATAAAAACAACAACAAACCGATAACAAACGACCCAAGCCTTCTAAGAGGAG
AAAACGGGATGGCTTTTAAACTACGCAAAAAGGCGCTCGTTGGCCTGTTCACGGCCGG

Figure 16LLLL

CGCAATGGTATATGCCGGTGCAGCGGCGAGTGGTGAAATCATTCTGCAGGGCTTCCAC
TGGCACTCCAAGTGGGGCGGCAACAATCAGGGTTGGTGGCAGGTGATGGAAGGTCAG
GCCAACACCATCGCCAACGCCGGCTTTACGCACGTGTGGTTCCCGCCGGTCCATAACT
CGGCCGATGCCGAGGGTTACCTACCCCGCGAGCTGAACAACCTCAACTCCAGCTATGG
CTCCGAAGCACAGCTGCGCAGCGCCATCCAGGCACTGAACAATCGCGGCGTGCATGCG
ATTGCCGATGTGGTCATGAACCACCGGGTGGGCTGCTCTGGCTGGCGGATTTCTGTA
ACCCGGACTGGCCGACCTGGTACATCGTCGCCAATGATTCCTGGCCCGGTGGCCCGAA
AAGCCAGAACTGGGACACGGGTGAGACGTACCACGCCGCCCGTGACCTCGATCACGC
CAATCCGCAGGTGCGCAACGATATCTCGCACTACCTGAACAGCCGCCTCAAGGACGTC
GGCTTCTCCGGCTGGCGCTGGGACTATGCCAAGGGTTTCTGGCCCGGCTATGTCGGCG
AGTACAACTGGAACACCAACCCGAACTTCTGTGTGGGTGAGGTGTGGGACGATCTCGA
CCCCAACAATCCCAACCCGCACCGCCAGCAACTGGTGGACTGGGTTGATGCTACCGGT
GGCAGTTGTCACGTCTTCGACTTCACCACCAAGGGGCTGACGAACTATGCGCTGCAGC
ATGGCCAGTACTGGCGCCTGCAGGGTGATAATGGTGGCCCGGCTGGCGGCATCGGCTG
GTGGCCGCAACGCATGGTGACCTTCGTCGACAACCATGACACGGGCCCGAGCAATCAC
TGTGGTGACGGCCAGAACCTCTGGCCCGTGCCCTGTGACAAGGTCATGGAGGCGTATG
CCTACATCCTGACCCATCCGGGCGTGCCGTCGGTGTACTGGACGCACTTCTTCAACTGG
AATCTTGGTAGCGAGATCAGCCAGTTGATGCAGATCCGCAAGAACCAGGGCGTGCACT
CCGGTTCCGACGTCTGGATCGCCGAGGCCCGTCACGGCCTGTACGCCGCCTATATCAA
CGGTAATGTGGCGATGAAGATGGGCTGGGATAACTGGAGCCCGGGCTGGGGCTGGTC
GCTGGCGGCCTCCGGTAACAACTGGGCCGTCTGGACACGCTGA

SEQ ID NO: 212
VFRSDTVSRTCMYGALRNAYQPDRVFTGVTVRTCNLKKHAHRQALLFIVTRCLCLKSRQT
HKNNNKPITNDPSLLRGENGMAFKLRKKALVGLFTAGAMVYAGAAASGEIILQGFHWHS
KWGGNNQGWWQVMEGQANTIANAGFTHVWFPPVHNSADAEGYLPRELNNLNSSYGSEA
QLRSAIQALNNRGVHAIADVVMNHRVGCSGWADFCNPDWPTWYIVANDSWPGGPKSQN
WDTGETYHAARDLDHANPQVRNDISHYLNSRLKDVGFSGWRWDYAKGFWPGYVGEYN
WNTNPNFCVGEVWDDLDPNNPNHRQQLVDWVDATGGSCHVFDFTTKGLTNYALQHGQ
YWRLQGDNGGPAGGIGWWPQRMVTFVDNHDTGPSNHCGDGQNLWPVPCDKVMEAYA
YILTHPGVPSVYWTHFFNWNLGSEISQLMQIRKNQGVHSGSDVWIAEARHGLYAAYINGN
VAMKMGWDNWSPGWGWSLAASGNNWAVWTR

Figure 16MMMM

US 7,407,677 B2

ENZYMES HAVING ALPHA AMYLASE ACTIVITY AND METHODS OF USE THEREOF

RELATED APPLICATION DATA

This application claims priority of U.S. Provisional Application No. 60/270,495, filed Feb. 21, 2001; U.S. Provisional Application No. 60/270,496, filed Feb. 21, 2001; and U.S. Provisional Application No. 60/291,122, filed May 14, 2001; all of which are herein incorporated by reference in their entirety.

FIELD OF THE INVENTION

This invention relates generally to enzymes, polynucleotides encoding the enzymes, the use of such polynucleotides and polypeptides, and more specifically to enzymes having alpha amylase activity.

BACKGROUND

Starch is a complex carbohydrate often found in the human diet. The structure of starch is glucose polymers linked by α-1,4 and α-1,6 glucosidic bonds. Amylase is an enzyme that catalyzes the hydrolysis of starches into sugars. Amylases hydrolyze internal α-1,4-glucosidic linkages in starch, largely at random, to produce smaller molecular weight malto-dextrins. The breakdown of starch is important in the digestive system and commercially. Amylases are of considerable commercial value, being used in the initial stages (liquefaction) of starch processing; in wet corn milling; in alcohol production; as cleaning agents in detergent matrices; in the textile industry for starch desizing; in baking applications; in the beverage industry; in oilfields in drilling processes; in inking of recycled paper; and in animal feed.

Amylases are produced by a wide variety of microorganisms including *Bacillus* and *Aspergillus*, with most commercial amylases being produced from bacterial sources such as *Bacillus licheniformis, Bacillus amyloliquefaciens, Bacillus subtilis,* or *Bacillus stearothermophilus*. In recent years, the enzymes in commercial use have been those from *Bacillus licheniformis* because of their heat stability and performance, at least at neutral and mildly alkaline pHs.

In general, starch to fructose processing consists of four steps: liquefaction of granular starch, saccharification of the liquefied starch into dextrose, purification, and isomerization to fructose. The object of a starch liquefaction process is to convert a concentrated suspension of starch polymer granules into a solution of soluble shorter chain length dextrins of low viscosity. This step is essential for convenient handling with standard equipment and for efficient conversion to glucose or $10^3$ other sugars. To liquefy granular starch, it is necessary to gelatinize the granules by raising the temperature of the granular starch to over about 72° C. The heating process instantaneously disrupts the insoluble starch granules to produce a water soluble starch solution. The solubilized starch solution is then liquefied by amylase. A starch granule is composed of: 69-74% amylopectin, 26-31% amylose, 11-14% water, 0.2-0.4% protein, 0.5-0.9% lipid, 0.05-0.1% ash, 0.02-0.03% phosphorus, 0.1% pentosan. Approximately 70% of a granule is amorphous and 30% is crystalline.

A common enzymatic liquefaction process involves adjusting the pH of a granular starch slurry to between 6.0 and 6.5, the pH optimum of alpha-amylase derived from *Bacillus licheniformis*, with the addition of calcium hydroxide, sodium hydroxide or sodium carbonate. The addition of calcium hydroxide has the advantage of also providing calcium ions which are known to stabilize the alpha-amylase against inactivation. Upon addition of alpha-amylase, the suspension is pumped through a steam jet to instantaneously raise the temperature to between 80 degree-115 degrees C. The starch is immediately gelatinized and, due to the presence of alpha-amylase, depolymerized through random hydrolysis of a (1-4) glycosidic bonds by alpha-amylase to a fluid mass which is easily pumped.

In a second variation to the liquefaction process, alpha-amylase is added to the starch suspension, the suspension is held at a temperature of 80-100 degrees C. to partially hydrolyze the starch granules, and the partially hydrolyzed starch suspension is pumped through a jet at temperatures in excess of about 105 degrees C. to thoroughly gelatinize any remaining granular structure. After cooling the gelatinized starch, a second addition of alpha-amylase can be made to further hydrolyze the starch.

A third variation of this process is called the dry milling process. In dry milling, whole grain is ground and combined with water. The germ is optionally removed by flotation separation or equivalent techniques. The resulting mixture, which contains starch, fiber, protein and other components of the grain, is liquefied using .alpha.-amylase. The general practice in the art is to undertake enzymatic liquefaction at a lower temperature when using the dry milling process. Generally, low temperature liquefaction is believed to be less efficient than high temperature liquefaction in converting starch to soluble dextrins.

Typically, after gelatinization the starch solution is held at an elevated temperature in the presence of alpha-amylase until a DE of 10-20 is achieved, usually a period of 1-3 hours. Dextrose equivalent (DE) is the industry standard for measuring the concentration of total reducing sugars, calculated as D-glucose on a dry weight basis. Unhydrolyzed granular starch has a DE of virtually zero, whereas the DE of D-glucose is defined as 100.

Corn wet milling is a process which produces corn oil, gluten meal, gluten feed and starch. Alkaline-amylase is used in the liquefaction of starch and glucoamylase is used in saccharification, producing glucose. Corn, a kernel of which consists of a outer seed coat (fiber), starch, a combination of starch and glucose and the inner germ, is subjected to a four step process, which results in the production of starch. The corn is steeped, de-germed, de-fibered, and finally the gluten is separated. In the steeping process, the solubles are taken out. The product remaining after removal of the solubles is de-germed, resulting in production of corn oil and production of an oil cake, which is added to the solubles from the steeping step. The remaining product is de-fibered and the fiber solids are added to the oil cake/solubles mixture. This mixture of fiber solids, oil cake and solubles forms a gluten feed. After de-fibering, the remaining product is subjected to gluten separation. This separation results in a gluten meal and starch. The starch is then subjected to liquefaction and saccharification to produce glucose.

Staling of baked products (such as bread) has been recognized as a problem which becomes more serious as more time lies between the moment of preparation of the bread product and the moment of consumption. The term staling is used to describe changes undesirable to the consumer in the properties of the bread product after leaving the oven, such as an increase of the firmness of the crumb, a decrease of the elasticity of the crumb, and changes in the crust, which becomes tough and leathery. The firmness of the bread crumb increases further during storage up to a level, which is considered as negative. The increase in crumb firmness, which is considered as the most important aspect of staling, is recognized by the consumer a long time before the bread product has otherwise become unsuitable for consumption.

There is a need in the industry for the identification and optimization of amylases, useful for various uses, including commercial cornstarch liquefaction processes. These second generation acid amylases will offer improved manufacturing and/or performance characteristics over the industry standard enzymes from *Bacillus licheniformis*, for example.

There is also a need for the identification and optimization of amylases having utility in automatic dish wash (ADW) products and laundry detergent. In ADW products, the amylase will function at pH 10-11 and at 45-60° C. in the presence of calcium chelators and oxidative conditions. For laundry, activity at pH 9-10 and 40° C. in the appropriate detergent matrix will be required. Amylases are also useful in textile desizing, brewing processes, starch modification in the paper and pulp industry and other processes described in the art.

The publications discussed herein are provided solely for their disclosure prior to the filing date of the present application. Nothing herein is to be construed as an admission that the invention is not entitled to antedate such disclosure by virtue of prior invention.

SUMMARY OF THE INVENTION

The invention provides an isolated nucleic acid having a sequence as set forth in SEQ ID Nos.: 1, 3, 5, 9, 11, 13, 15, 17, 19, 21, 23, 25, 27, 29, 31, 33, 35, 37, 39, 41, 43, 45 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299 and variants thereof having at least 50% sequence identity to SEQ ID Nos.: 1, 3, 5, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299 and encoding polypeptides having alpha amylase activity.

One aspect of the invention is an isolated nucleic acid having a sequence as set forth in SEQ ID Nos: 1, 3, 5, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299 (hereinafter referred to as "Group A nucleic acid sequences"), sequences substantially identical thereto, and sequences complementary thereto.

Another aspect of the invention is an isolated nucleic acid including at least 10 consecutive bases of a sequence as set forth in Group A nucleic acid sequences, sequences substantially identical thereto, and the sequences complementary thereto.

In yet another aspect, the invention provides an isolated nucleic acid encoding a polypeptide having a sequence as set forth in SEQ ID Nos.: 2, 4, 6, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298 and variants thereof encoding a polypeptide having alpha amylase activity and having at least 50% sequence identity to such sequences.

Another aspect of the invention is an isolated nucleic acid encoding a polypeptide or a functional fragment thereof having a sequence as set forth in SEQ ID Nos.: 2, 4, 6, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298 (hereinafter referred to as "Group B amino acid sequences"), and sequences substantially identical thereto.

Another aspect of the invention is an isolated nucleic acid encoding a polypeptide having at least 10 consecutive amino acids of a sequence as set forth in Group B amino acid sequences, and sequences substantially identical thereto.

In yet another aspect, the invention provides a purified polypeptide having a sequence as set forth in Group B amino acid sequences, and sequences substantially identical thereto.

Another aspect of the invention is an isolated or purified antibody that specifically binds to a polypeptide having a sequence as set forth in Group B amino acid sequences, and sequences substantially identical thereto.

Another aspect of the invention is an isolated or purified antibody or binding fragment thereof, which specifically binds to a polypeptide having at least 10 consecutive amino acids of one of the polypeptides of Group B amino acid sequences, and sequences substantially identical thereto.

Another aspect of the invention is a method of making a polypeptide having a sequence as set forth in Group B amino acid sequences, and sequences substantially identical thereto. The method includes introducing a nucleic acid encoding the polypeptide into a host cell, wherein the nucleic acid is operably linked to a promoter, and culturing the host cell under conditions that allow expression of the nucleic acid.

Another aspect of the invention is a method of making a polypeptide having at least 10 amino acids of a sequence as set forth in Group B amino acid sequences, and sequences substantially identical thereto. The method includes introducing a nucleic acid encoding the polypeptide into a host cell, wherein the nucleic acid is operably linked to a promoter, and culturing the host cell under conditions that allow expression of the nucleic acid, thereby producing the polypeptide.

Another aspect of the invention is a method of generating a variant including obtaining a nucleic acid having a sequence as set forth in Group A nucleic acid sequences, sequences substantially identical thereto, sequences complementary to the sequences of Group A nucleic acid sequences, fragments comprising at least 30 consecutive nucleotides of the foregoing sequences, and changing one or more nucleotides in the sequence to another nucleotide, deleting one or more nucleotides in the sequence, or adding one or more nucleotides to the sequence.

Another aspect of the invention is a computer readable medium having stored thereon a sequence as set forth in Group A nucleic acid sequences, and sequences substantially identical thereto, or a polypeptide sequence as set forth in Group B amino acid sequences, and sequences substantially identical thereto.

Another aspect of the invention is a computer system including a processor and a data storage device wherein the data storage device has stored thereon a sequence as set forth in Group A nucleic acid sequences, and sequences substantially identical thereto, or a polypeptide having a sequence as set forth in Group B amino acid sequences, and sequences substantially identical thereto.

Another aspect of the invention is a method for comparing a first sequence to a reference sequence wherein the first sequence is a nucleic acid having a sequence as set forth in Group A nucleic acid sequences, and sequences substantially identical thereto, or a polypeptide code of Group B amino acid sequences, and sequences substantially identical thereto. The method includes reading the first sequence and the reference sequence through use of a computer program which compares sequences; and determining differences between the first sequence and the reference sequence with the computer program.

Another aspect of the invention is a method for identifying a feature in a sequence as set forth in Group A nucleic acid sequences, and sequences substantially identical thereto, or a polypeptide having a sequence as set forth in Group B amino acid sequences, and sequences substantially identical thereto, including reading the sequence through the use of a computer program which identifies features in sequences; and identifying features in the sequence with the computer program.

Another aspect of the invention is an assay for identifying fragments or variants of Group B amino acid sequences, and sequences substantially identical thereto, which retain the enzymatic function of the polypeptides of Group B amino acid sequences, and sequences substantially identical thereto. The assay includes contacting the polypeptide of Group B amino acid sequences, sequences substantially identical thereto, or polypeptide fragment or variant with a substrate molecule under conditions which allow the polypeptide fragment or variant to function, and detecting either a decrease in the level of substrate or an increase in the level of the specific reaction product of the reaction between the polypeptide and substrate thereby identifying a fragment or variant of such sequences.

The invention also provides a process for preparing a dough or a baked product prepared from the dough which comprises adding an amylase of the invention to the dough in an amount which is effective to retard the staling of the bread. The invention also provides a dough comprising said amylase and a premix comprising flour together with said amylase. Finally, the invention provides an enzymatic baking additive, which contains said amylase.

The use of the amylase in accordance with the present invention provides an improved anti-staling effect as measured by, e.g. less crumb firming, retained crumb elasticity, improved slice-ability (e.g. fewer crumbs, non-gummy crumb), improved palatability or flavor.

BRIEF DESCRIPTION OF THE DRAWINGS

The following drawings are illustrative of embodiments of the invention and are not meant to limit the scope of the invention as encompassed by the claims.

FIG. 9 is a graph of the pH and temperature data for a selection of the amylases characterized.

FIG. 10 sets forth the sequences to be used in reassembly experiments with the enzymes.

FIG. 11 illustrates a sample Standard Curve of the assay of Example 5.

FIG. 12 illustrates the pH rate profiles for SEQ ID NO.: 127, which has a neutral optimum pH and SEQ ID NO.: 211, which has an optimum around pH 10. SEQ ID NO.: 127 is a control; an enzyme that was discovered previously and has a neutral pH optimum. SEQ ID NO.: 211 is a more recently discovered amylase and has an optimum around pH 10. Pure protein was used in these assays.

FIG. 13 shows the stability of Diversa amylases vs. a commercial enzyme, as discussed in Example 2.

FIGS. 14A-14C show the sequence alignments of hypothermophilic α-amylases, as set forth in Example 8. FIGS. 14A-1 and A-2 show an alignments of amylase sequences. SEQ ID NO.:82=an environmental clone; pyro=*Pyrococcus* sp. (SEQ ID NO:313) (strain:KOD1), Tachibana, Y., Mendez, L., Takagi, M. and Imanaka, T., J Ferment. Bioeng. 82:224-232, 1996; pyro2=*Pyrococcus furiosus* (SEQ ID NO:314), Appl. Environ. Microbiol. 63 (9):3569-3576, 1997; Thermo=*Thermococcus* sp.(SEQ ID NO:315); Thermo2=*Thermococcus hydrothermalis* (SEQ ID NO:316), Leveque, E. et al. Patent: France 98.05655 05-MAY-1998, unpublished and a consensus sequence (SEQ ID NO:317). FIG. 14B-1 to 14B-3 show the amino acid sequence alignment of identified sequences: SEQ ID NO.:82; pyro (SEQ ID NO:313); SEQ ID NO.:74; thermo2 (SEQ ID NO:316); SEQ ID NO.:76; SEQ ID NO:78; SEQ ID NO.:84; SEQ ID NO.: 86; SEQ ID NO.:80); thermo (SEQ ID NO:315); pyro2 (SEQ ID NO:314); clone A (SEQ ID NO:318); and a consensus sequence (SEQ ID NO:319). FIGS. 14C-1 to 14C-6 show the nucleic acid sequence alignment corresponding to the polypeptide sequence of FIGS. 5 and 6. SEQ ID NO.:81; SEQ ID NO.:75; SEQ ID NO.:77; SEQ ID NO.:83; SEQ ID NO.: 85; SEQ ID NO.:79; clone A; and SEQ ID NO.:73.

FIGS. 16A-16MMMM are the sequences of the invention.

DETAILED DESCRIPTION OF THE INVENTION

Figure 1:
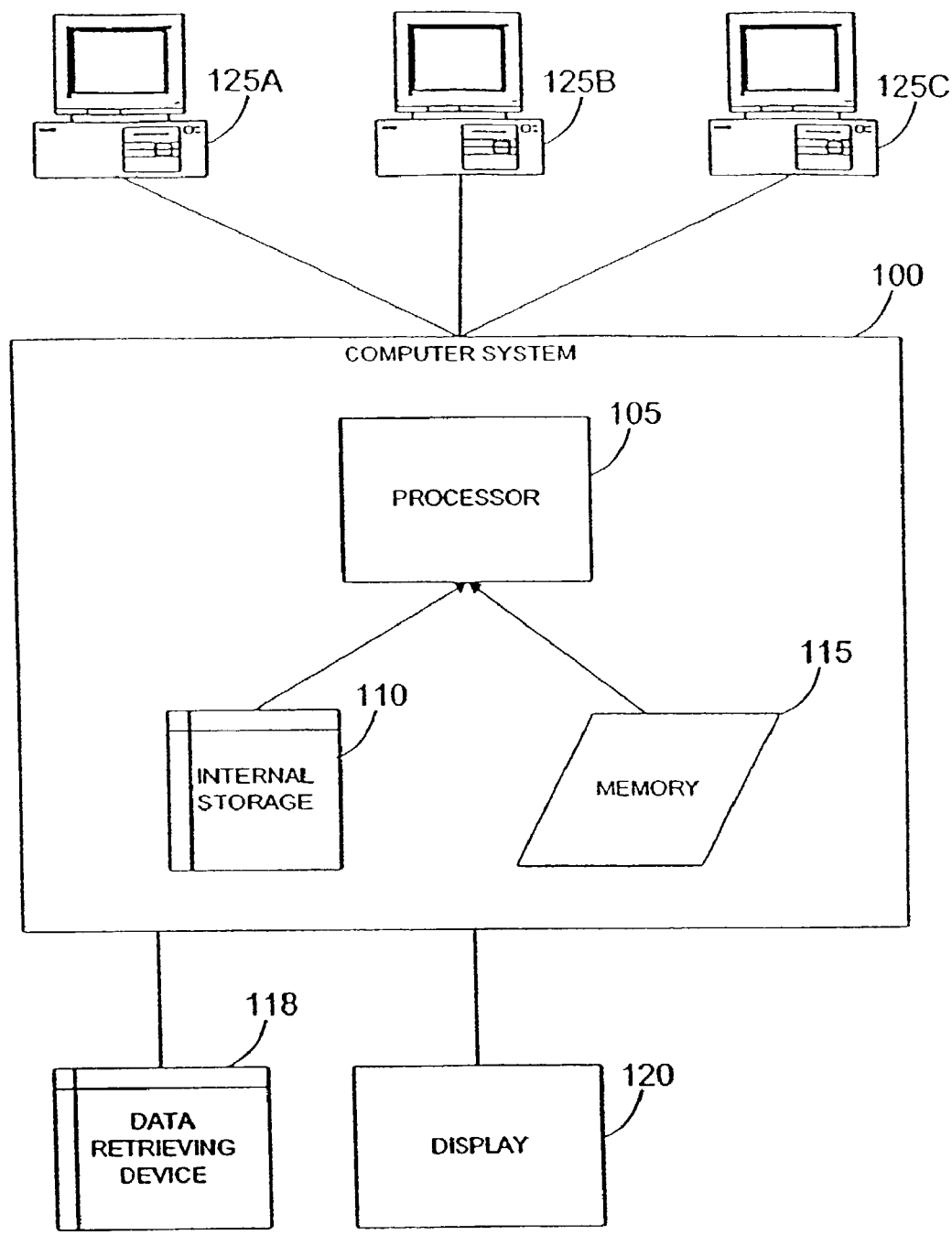
FIG. 1 is a block diagram of a computer system.

The present invention relates to amylases and polynucleotides encoding them. As used herein, the term "amylase" encompasses enzymes having alpha amylase activity, for example, alpha amylases capable of hydrolyzing internal α-1, 4-glucan links in polysaccharides, including amylase enzymes capable of hydrolyzing starch to sugars at alkaline pHs or at acidic pHs. Amylases of the invention are particularly useful in corn-wet milling processes, detergents, baking processes, beverages and in oilfields (fuel ethanol). Amylases are also useful in textile desizing, brewing processes, starch modification in the paper and pulp industry and other processes described in the art.

The polynucleotides of the invention have been identified as encoding polypeptides having alpha amylase or alkaline amylase activity. Alkaline amylases of the invention may include, but are not limited to: SEQ ID NO.: 115, SEQ ID NO.:207, SEQ ID NO.: 139, SEQ ID NO.:127, SEQ ID NO.: 137, SEQ ID NO.: 113, SEQ ID NO.:205, SEQ ID NO.: 179, SEQ ID NO.: 151, SEQ ID NO.: 187, SEQ ID NO.:97, SEQ ID NO.: 153, SEQ ID NO.: 69, SEQ ID NO.: 135, SEQ ID NO.: 189, SEQ ID NO.: 119, SEQ ID NO: 209 and SEQ ID NO: 211.

Alterations in properties which may be achieved in variants of the invention are alterations in, e.g., substrate specificity, substrate binding, substrate cleavage pattern, thermal stability, pI/activity profile, pI/stability profile [such as increased stability at low (e.g. pH<6, in particular pH<5) or high (e.g. pH>9) pH values], stability towards oxidation, $Ca^{2+}$ dependency, specific activity, and other properties of interest. For instance, the alteration may result in a variant which, as compared to the parent amylase, has a reduced $Ca^{2+}$ dependency and/or an altered pH/activity profile.

The present invention relates to alpha amylases and polynucleotides encoding them. As used herein, the term "alpha amylase" encompasses enzymes having alpha amylase activity, for example, enzymes capable of hydrolyzing starch to sugars. Unlike many known amylases, the amylases of the invention may not be calcium-dependent enzymes.

It is highly desirable to be able to decrease the Ca2+ dependency of an alpha amylase. Accordingly, one aspect of the invention provides an amylase enzyme that has a decreased Ca2+ dependency as compared to commercial or parent amylases. Decreased Ca2+ dependency will in general have the functional consequence that the variant exhibits a satisfactory amylolytic activity in the presence of a lower concentration of calcium ion in the extraneous medium than is necessary for a commercial or parent enzyme. It will further often have the consequence that the variant is less sensitive to calcium ion-depleting conditions such as those obtained in media containing calcium-complexing agents (such as certain detergent builders).

"Liquefaction" or "liquefy" means a process by which starch is converted to shorter chain and less viscous dextrins. Generally, this process involves gelatinization of starch simultaneously with or followed by the addition of alpha amylase. In commercial processes, it is preferred that the granular starch is derived from a source comprising corn, wheat, milo, sorghum, rye or bulgher. However, the present invention applies to any grain starch source which is useful in liquefaction, e.g., any other grain or vegetable source known to produce starch suitable for liquefaction.

"Granular starch" or "starch granules" means a water-insoluble component of edible grains which remains after removal of the hull, fiber, protein, fat, germ, and solubles through the steeping, mechanical cracking, separations, screening, countercurrent rinsing and centrifugation steps typical of the grain wet-milling process. Granular starch comprises intact starch granules containing, almost exclusively, packed starch molecules (i.e., amylopectin and amylose). In corn, the granular starch component comprises about 99% starch; the remaining 1% being comprised of protein, fat, ash, fiber and trace components tightly associated with the granules. The packing structure of granular starch severely retards the ability of .alpha.-amylase to hydrolyze starch. Gelatinization of the starch is utilized to disrupt the granules to form a soluble starch solution and facilitate enzymatic hydrolysis.

"Starch solution" means the water soluble gelatinized starch which results from heating granular starch. Upon heating of the granules to above about 72 degrees C., granular starch dissociates to form an aqueous mixture of loose starch molecules. This mixture comprising, for example, about 75% amylopectin and 25% amylose in yellow dent corn forms a viscous solution in water. In commercial processes to form glucose or fructose, it is the starch solution which is liquefied to form a soluble dextrin solution. "alpha amylase" means an enzymatic activity which cleaves or hydrolyzes the alpha (1-4) glycosidic bond, e.g., that in starch, amylopectin or amylose polymers. Suitable alpha amylases are the naturally occurring alpha amylases as well as recombinant or mutant amylases which are useful in liquefaction of starch. Techniques for producing variant amylases having activity at a pH or temperature, for example, that is different from the wild-type amylase, are included herein.

The temperature range of the liquefaction is generally any liquefaction temperature which is known to be effective in liquefying starch. Preferably, the temperature of the starch is between about 80 degrees C. to about 115 degrees C., more preferably from about 100 degrees C. to about 110 degrees C., and most preferably from about 105 degrees C. to about 108 degrees C.

In one embodiment, the signal sequences of the invention are identified following identification of novel amylase polypeptides. The pathways by which proteins are sorted and transported to their proper cellular location are often referred to as protein targeting pathways. One of the most important elements in all of these targeting systems is a short amino acid sequence at the amino terminus of a newly synthesized polypeptide called the signal sequence. This signal sequence directs a protein to its appropriate location in the cell and is removed during transport or when the protein reaches its final destination. Most lysosomal, membrane, or secreted proteins have an amino-terminal signal sequence that marks them for translocation into the lumen of the endoplasmic reticulum. More than 100 signal sequences for proteins in this group have been determined. The sequences vary in length from 13 to 36 amino acid residues. Various methods of recognition of signal sequences are known to those of skill in the art. In one embodiment, the peptides are identified by a method referred to as SignalP. SignalP uses a combined neural network which recognizes both signal peptides and their cleavage sites.

(Nielsen, H., Engelbrecht, J., Brunalk, S., von Heijne, G., "Identification of prokaryotic and eukaryotic signal peptides and prediction of their cleavage sites." Protein Engineering, vol. 10, no. 1, p. 1-6 (1997), hereby incorporated by reference.) It should be understood that some of the amylases of the invention may not have signal sequences. It may be desirable to include a nucleic acid sequence encoding a signal sequence from one amylase operably linked to a nucleic acid sequence of a different amylase or, optionally, a signal sequence from a non-amylase protein may be desired. Table 3 shows signal seqeunes of the invention.

The phrases "nucleic acid" or "nucleic acid sequence" as used herein refer to an oligonucleotide, nucleotide, polynucleotide, or to a fragment of any of these, to DNA or RNA of genomic or synthetic origin which may be single-stranded or double-stranded and may represent a sense or antisense strand, to peptide nucleic acid (PNA), or to any DNA-like or RNA-like material, natural or synthetic in origin.

A "coding sequence of" or a "nucleotide sequence encoding" a particular polypeptide or protein, is a nucleic acid sequence which is transcribed and translated into a polypeptide or protein when placed under the control of appropriate regulatory sequences.

The term "gene" means the segment of DNA involved in producing a polypeptide chain; it includes regions preceding and following the coding region (leader and trailer) as well as, where applicable, intervening sequences (introns) between individual coding segments (exons).

"Amino acid" or "amino acid sequence" as used herein refer to an oligopeptide, peptide, polypeptide, or protein sequence, or to a fragment, portion, or subunit of any of these, and to naturally occurring or synthetic molecules.

The term "polypeptide" as used herein, refers to amino acids joined to each other by peptide bonds or modified peptide bonds, i.e., peptide isosteres, and may contain modified amino acids other than the 20 gene-encoded amino acids. The polypeptides may be modified by either natural processes, such as post-translational processing, or by chemical modification techniques which are well known in the art. Modifications can occur anywhere in the polypeptide, including the peptide backbone, the amino acid side-chains and the amino or carboxyl termini. It will be appreciated that the same type of modification may be present in the same or varying degrees at several sites in a given polypeptide. Also a given polypeptide may have many types of modifications. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of a phosphytidylinositol, cross-linking cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristolyation, oxidation, pergylation, proteolytic processing, phosphorylation, prenylation, racemization, selenoylation, sulfation, and transfer-RNA mediated addition of amino acids to protein such as arginylation. (See Creighton, T. E., Proteins—Structure and Molecular Properties 2nd Ed., W. H. Freeman and Company, New York (1993); Posttranslational Covalent Modification of Proteins, B. C. Johnson, Ed., Academic Press, New York, pp. 1-12 (1983)).

As used herein, the term "isolated" means that the material is removed from its original environment (e.g., the natural environment if it is naturally occurring). For example, a naturally-occurring polynucleotide or polypeptide present in a living animal is not isolated, but the same polynucleotide or polypeptide, separated from some or all of the coexisting materials in the natural system, is isolated. Such polynucleotides could be part of a vector and/or such polynucleotides or polypeptides could be part of a composition, and still be isolated in that such vector or composition is not part of its natural environment.

As used herein, the term "purified" does not require absolute purity; rather, it is intended as a relative definition. Individual nucleic acids obtained from a library have been conventionally purified to electrophoretic homogeneity. The sequences obtained from these clones could not be obtained directly either from the library or from total human DNA. The purified nucleic acids of the invention have been purified from the remainder of the genomic DNA in the organism by at least 104-106 fold. However, the term "purified" also includes nucleic acids which have been purified from the remainder of the genomic DNA or from other sequences in a library or other environment by at least one order of magnitude, typically two or three orders, and more typically four or five orders of magnitude.

As used herein, the term "recombinant" means that the nucleic acid is adjacent to a "backbone" nucleic acid to which it is not adjacent in its natural environment. Additionally, to be "enriched" the nucleic acids will represent 5% or more of the number of nucleic acid inserts in a population of nucleic acid backbone molecules. Backbone molecules according to the invention include nucleic acids such as expression vectors, self-replicating nucleic acids, viruses, integrating nucleic acids, and other vectors or nucleic acids used to maintain or manipulate a nucleic acid insert of interest. Typically, the enriched nucleic acids represent 15% or more of the number of nucleic acid inserts in the population of recombinant backbone molecules. More typically, the enriched nucleic acids represent 50% or more of the number of nucleic acid inserts in the population of recombinant backbone molecules. In a one embodiment, the enriched nucleic acids represent 90% or more of the number of nucleic acid inserts in the population of recombinant backbone molecules.

"Recombinant" polypeptides or proteins refer to polypeptides or proteins produced by recombinant DNA techniques; i.e., produced from cells transformed by an exogenous DNA construct encoding the desired polypeptide or protein. "Synthetic" polypeptides or protein are those prepared by chemical synthesis. Solid-phase chemical peptide synthesis methods can also be used to synthesize the polypeptide or fragments of the invention. Such method have been known in the art since the early 1960's (Merrifield, R. B., J. Am. Chem. Soc., 85:2149-2154, 1963) (See also Stewart, J. M. and Young, J. D., Solid Phase Peptide Synthesis, 2nd Ed., Pierce Chemical Co., Rockford, Ill., pp. 11-12)) and have recently been employed in commercially available laboratory peptide design and synthesis kits (Cambridge Research Biochemicals). Such commercially available laboratory kits have generally utilized the teachings of H. M. Geysen et al, Proc. Natl. Acad. Sci., USA, 81:3998 (1984) and provide for synthesizing peptides upon the tips of a multitude of "rods" or "pins" all of which are connected to a single plate. When such a system is utilized, a plate of rods or pins is inverted and inserted into a second plate of corresponding wells or reservoirs, which contain solutions for attaching or anchoring an appropriate amino acid to the pin's or rod's tips. By repeating such a process step, i.e., inverting and inserting the rod's and pin's tips into appropriate solutions, amino acids are built into desired peptides. In addition, a number of available FMOC peptide synthesis systems are available. For example, assembly of a polypeptide or fragment can be carried out on a solid support using an Applied Biosystems, Inc. Model 431 A automated peptide synthesizer. Such equipment provides ready access to the peptides of the invention, either by direct synthesis or by synthesis of a series of fragments that can be coupled using other known techniques.

A promoter sequence is "operably linked to" a coding sequence when RNA polymerase which initiates transcription at the promoter will transcribe the coding sequence into mRNA.

"Plasmids" are designated by a lower case "p" preceded and/or followed by capital letters and/or numbers. The starting plasmids herein are either commercially available, publicly available on an unrestricted basis, or can be constructed from available plasmids in accord with published procedures. In addition, equivalent plasmids to those described herein are known in the art and will be apparent to the ordinarily skilled artisan.

"Digestion" of DNA refers to catalytic cleavage of the DNA with a restriction enzyme that acts only at certain sequences in the DNA. The various restriction enzymes used herein are commercially available and their reaction conditions, cofactors and other requirements were used as would be known to the ordinarily skilled artisan. For analytical purposes, typically 1 μg of plasmid or DNA fragment is used with about 2 units of enzyme in about 20 μl of buffer solution. For the purpose of isolating DNA fragments for plasmid construction, typically 5 to 50 μg of DNA are digested with 20 to 250 units of enzyme in a larger volume. Appropriate buffers and substrate amounts for particular restriction enzymes are specified by the manufacturer. Incubation times of about 1 hour at 37° C. are ordinarily used, but may vary in accordance with the supplier's instructions. After digestion, gel electrophoresis may be performed to isolate the desired fragment.

"Oligonucleotide" refers to either a single stranded polydeoxynucleotide or two complementary polydeoxynucleotide strands which may be chemically synthesized. Such synthetic oligonucleotides have no 5' phosphate and thus will not ligate to another oligonucleotide without adding a phosphate with an ATP in the presence of a kinase. A synthetic oligonucleotide will ligate to a fragment that has not been dephosphorylated.

The phrase "substantially identical" in the context of two nucleic acids or polypeptides, refers to two or more sequences that have at least 50%, 60%, 70%, 80%, and in some aspects 90-95% nucleotide or amino acid residue identity, when compared and aligned for maximum correspondence, as measured using one of the known sequence comparison algorithms or by visual inspection. Typically, the substantial identity exists over a region of at least about 100 residues, and most commonly the sequences are substantially identical over at least about 150-200 residues. In some embodiments, the sequences are substantially identical over the entire length of the coding regions.

Additionally a "substantially identical" amino acid sequence is a sequence that differs from a reference sequence by one or more conservative or non-conservative amino acid substitutions, deletions, or insertions, particularly when such a substitution occurs at a site that is not the active site of the molecule, and provided that the polypeptide essentially retains its functional properties. A conservative amino acid substitution, for example, substitutes one amino acid for another of the same class (e.g., substitution of one hydrophobic amino acid, such as isoleucin, valine, leucine, or methionine, for another, or substitution of one polar amino acid for another, such as substitution of arginine for lysine, glutamic acid for aspartic acid or glutamine for asparagine). One or more amino acids can be deleted, for example, from an alpha amylase polypeptide, resulting in modification of the structure of the polypeptide, without significantly altering its biological activity. For example, amino- or carboxyl-terminal amino acids that are not required for alpha amylase biological activity can be removed. Modified polypeptide sequences of the invention can be assayed for alpha amylase biological activity by any number of methods, including contacting the modified polypeptide sequence with an alpha amylase substrate and determining whether the modified polypeptide decreases the amount of specific substrate in the assay or increases the bioproducts of the enzymatic reaction of a functional alpha amylase polypeptide with the substrate.

"Fragments" as used herein are a portion of a naturally occurring protein which can exist in at least two different conformations. Fragments can have the same or substantially the same amino acid sequence as the naturally occurring protein. "Substantially the same" means that an amino acid sequence is largely, but not entirely, the same, but retains at least one functional activity of the sequence to which it is related. In general two amino acid sequences are "substantially the same" or "substantially homologous" if they are at least about 85% identical. Fragments which have different three dimensional structures as the naturally occurring protein are also included. An example of this, is a "pro-form" molecule, such as a low activity proprotein that can be modified by cleavage to produce a mature enzyme with significantly higher activity.

"Hybridization" refers to the process by which a nucleic acid strand joins with a complementary strand through base pairing. Hybridization reactions can be sensitive and selective so that a particular sequence of interest can be identified even in samples in which it is present at low concentrations. Suitably stringent conditions can be defined by, for example, the concentrations of salt or formamide in the prehybridization and hybridization solutions, or by the hybridization temperature, and are well known in the art. In particular, stringency can be increased by reducing the concentration of salt, increasing the concentration of formamide, or raising the hybridization temperature.

For example, hybridization under high stringency conditions could occur in about 50% formamide at about 37° C. to 42° C. Hybridization could occur under reduced stringency conditions in about 35% to 25% formamide at about 30° C. to 35° C. In particular, hybridization could occur under high stringency conditions at 42° C. in 50% formamide, 5×SSPE, 0.3% SDS, and 200 n/ml sheared and denatured salmon sperm DNA. Hybridization could occur under reduced stringency conditions as described above, but in 35% formamide at a reduced temperature of 35° C. The temperature range corresponding to a particular level of stringency can be further narrowed by calculating the purine to pyrimidine ratio of the nucleic acid of interest and adjusting the temperature accordingly. Variations on the above ranges and conditions are well known in the art.

The term "variant" refers to polynucleotides or polypeptides of the invention modified at one or more base pairs, codons, introns, exons, or amino acid residues (respectively) yet still retain the biological activity of an alpha amylase of the invention. Variants can be produced by any number of means included methods such as, for example, error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, GSSM and any combination thereof. Techniques for producing variant amylases having activity at a pH or temperature, for example, that is different from the wild-type amylase, are included herein.

Enzymes are highly selective catalysts. Their hallmark is the ability to catalyze reactions with exquisite stereo-, regio-, and chemo-selectivities that are unparalleled in conventional synthetic chemistry. Moreover, enzymes are remarkably versatile. They can be tailored to function in organic solvents, operate at extreme pHs (for example, high pHs and low pHs) extreme temperatures (for example, high temperatures and low temperatures), extreme salinity levels (for example, high salinity and low salinity), and catalyze reactions with compounds that are structurally unrelated to their natural, physiological substrates.

Enzymes are reactive toward a wide range of natural and unnatural substrates, thus enabling the modification of virtually any organic lead compound. Moreover, unlike traditional chemical catalysts, enzymes are highly enantio- and regio-selective. The high degree of functional group specificity exhibited by enzymes enables one to keep track of each reaction in a synthetic sequence leading to a new active compound. Enzymes are also capable of catalyzing many diverse reactions unrelated to their physiological function in nature. For example, peroxidases catalyze the oxidation of phenols by hydrogen peroxide. Peroxidases can also catalyze hydroxylation reactions that are not related to the native function of the enzyme. Other examples are proteases which catalyze the breakdown of polypeptides. In organic solution some proteases can also acylate sugars, a function unrelated to the native function of these enzymes.

In one aspect, the invention includes a method for liquefying a starch containing composition comprising contacting the starch with a polypeptide of the invention (e.g., a purified polypeptide selected from polypeptides having an amino acid sequence selected from the group consisting of: Group B amino acid sequences; variants having at least about 50% homology to at least one of Group B amino acid sequences, over a region of at least about 100 residues, as determined by analysis with a sequence comparison algorithm or by visual inspection; sequences complementary to any one of Group B amino acid sequences; and sequences complementary to variants having at least about 50% homology to any one of Group B amino acid sequences over a region of at least about 100 residues, as determined by analysis with a sequence comparison algorithm or by visual inspection; and polypeptides having at least 10 consecutive amino acids of a polypeptide having a sequence selected from the group consisting of Group B amino acid sequences). In one preferred embodiment, the polypeptide is set forth in Group B amino acid sequences. The starch may be from a material selected from rice, germinated rice, corn, barley, wheat, legumes and sweet potato. A glucose syrup produced by the method of the invention is included herein. Such a syrup can be a maltose syrup, a glucose syrup, or a combination thereof. In particular, the syrups produced using the amylases of the invention there is a higher level of DP2 fraction and a higher level of DP3 (maltotriose and/or panose) and less of the greater than DP7 fragments as compared to the syrups produced by commercial enzymes. This is consistent with the liquefaction profile since less of the large fragments are in the invention liquefied syrups.

The invention also provides a method for removing starch containing stains from a material comprising contacting the material with a polypeptide of the invention. In one aspect, the invention provides a method for washing an object comprising contacting the object with a polypeptide of the invention under conditions sufficient for washing. A polypeptide of the invention may be included as a detergent additive for example. The invention also includes a method for textile desizing comprising contacting the textile with a polypeptide of the invention under conditions sufficient for desizing.

The invention also provides a method of reducing the staling of bakery products comprising addition of a polypeptide of the invention to the bakery product, prior to baking.

The invention also provides a method for the treatment of lignocellulosic fibers, wherein the fibers are treated with a polypeptide of the invention, in an amount which is efficient for improving the fiber properties. The invention includes a for enzymatic deinking of recycled paper pulp, wherein the polypeptide is applied in an amount which is efficient for effective deinking of the fiber surface.

Any of the methods described herein include the possibility of the addition of a second alpha amylase or a beta amylase or a combination thereof. Commercial amylases or other enzymes suitable for use in combination with an enzyme of the invention are known to those of skill in the art.

The invention also includes a method of increasing the flow of production fluids from a subterranean formation by removing a viscous, starch-containing, damaging fluid formed during production operations and found within the subterranean formation which surrounds a completed well bore comprising allowing production fluids to flow from the well bore; reducing the flow of production fluids from the formation below expected flow rates; formulating an enzyme treatment by blending together an aqueous fluid and a polypeptide of the invention; pumping the enzyme treatment to a desired location within the well bore; allowing the enzyme treatment to degrade the viscous, starch-containing, damaging fluid, whereby the fluid can be removed from the subterranean formation to the well surface; and wherein the enzyme treatment is effective to attack the alpha glucosidic linkages in the starch-containing fluid.

The present invention exploits the unique catalytic properties of enzymes. Whereas the use of biocatalysts (i.e., purified or crude enzymes, non-living or living cells) in chemical transformations normally requires the identification of a particular biocatalyst that reacts with a specific starting compound, the present invention uses selected biocatalysts and reaction conditions that are specific for functional groups that are present in many starting compounds.

Each biocatalyst is specific for one functional group, or several related functional groups, and can react with many starting compounds containing this functional group.

The biocatalytic reactions produce a population of derivatives from a single starting compound. These derivatives can be subjected to another round of biocatalytic reactions to produce a second population of derivative compounds. Thousands of variations of the original compound can be produced with each iteration of biocatalytic derivatization.

Enzymes react at specific sites of a starting compound without affecting the rest of the molecule, a process which is very difficult to achieve using traditional chemical methods. This high degree of biocatalytic specificity provides the means to identify a single active compound within the library. The library is characterized by the series of biocatalytic reactions used to produce it, a so-called "biosynthetic history". Screening the library for biological activities and tracing the biosynthetic history identifies the specific reaction sequence producing the active compound. The reaction sequence is repeated and the structure of the synthesized compound determined. This mode of identification, unlike other synthesis and screening approaches, does not require immobilization technologies, and compounds can be synthesized and tested free in solution using virtually any type of screening assay. It is important to note, that the high degree of specificity of enzyme reactions on functional groups allows for the "tracking" of specific enzymatic reactions that make up the biocatalytically produced library.

There are many advantages to screening lambda phage libraries for expression-based discovery of amylases. These include improved detection of toxic clones; improved access to substrate; reduced need for engineering a host; by-passing the potential for any bias resulting from mass excision of the library; and faster growth at low clone densities. Additionally, there are advantages to screening lambda phage libraries in liquid phase over solid phase. These include: greater flexibility in assay conditions; additional substrate flexibility; higher sensitivity for weak clones; and ease of automation.

Many of the procedural steps are performed using robotic automation enabling the execution of many thousands of biocatalytic reactions and screening assays per day as well as ensuring a high level of accuracy and reproducibility. As a result, a library of derivative compounds can be produced in a matter of weeks which would take years to produce using current chemical methods. (For further teachings on modification of molecules, including small molecules, see PCT/US94709 174, herein incorporated by reference in its entirety).

In one aspect, the present invention provides a non-stochastic method termed synthetic gene reassembly, that is somewhat related to stochastic shuffling, save that the nucleic acid building blocks are not shuffled or concatenated or chimerized randomly, but rather are assembled non-stochastically.

The synthetic gene reassembly method does not depend on the presence of a high level of homology between polynucleotides to be shuffled. The invention can be used to non-stochastically generate libraries (or sets) of progeny molecules comprised of over $10^{100}$ different chimeras. Conceivably, synthetic gene reassembly can even be used to generate libraries comprised of over $10^{1000}$ different progeny chimeras. Thus, in one aspect, the invention provides a non-stochastic method of producing a set of finalized chimeric nucleic acid molecules having an overall assembly order that is chosen by design, which method is comprised of the steps of generating by design a plurality of specific nucleic acid building blocks having serviceable mutually compatible ligatable ends, and assembling these nucleic acid building blocks, such that a designed overall assembly order is achieved.

The mutually compatible ligatable ends of the nucleic acid building blocks to be assembled are considered to be "serviceable" for this type of ordered assembly if they enable the building blocks to be coupled in predetermined orders. Thus, in one aspect, the overall assembly order in which the nucleic acid building blocks can be coupled is specified by the design of the ligatable ends and, if more than one assembly step is to be used, then the overall assembly order in which the nucleic acid building blocks can be coupled is also specified by the sequential order of the assembly step(s). In a one embodiment of the invention, the annealed building pieces are treated with an enzyme, such as a ligase (e.g., T4 DNA ligase) to achieve covalent bonding of the building pieces.

In a another embodiment, the design of nucleic acid building blocks is obtained upon analysis of the sequences of a set of progenitor nucleic acid templates that serve as a basis for producing a progeny set of finalized chimeric nucleic acid molecules. These progenitor nucleic acid templates thus serve as a source of sequence information that aids in the design of the nucleic acid building blocks that are to be mutagenized, e.g., chimerized or shuffled.

In one exemplification, the invention provides for the chimerization of a family of related genes and their encoded family of related products. In a particular exemplification, the encoded products are enzymes. The amylases of the present invention, for example, alpha amylases or alkaline amylases, can be mutagenized in accordance with the methods described herein.

Thus according to one aspect of the invention, the sequences of a plurality of progenitor nucleic acid templates (e.g., polynucleotides of Group A nucleic acid sequences) are aligned in order to select one or more demarcation points, which demarcation points can be located at an area of homology. The demarcation points can be used to delineate the boundaries of nucleic acid building blocks to be generated. Thus, the demarcation points identified and selected in the progenitor molecules serve as potential chimerization points in the assembly of the progeny molecules.

Typically a serviceable demarcation point is an area of homology (comprised of at least one homologous nucleotide base) shared by at least two progenitor templates, but the demarcation point can be an area of homology that is shared by at least half of the progenitor templates, at least two thirds of the progenitor templates, at least three fourths of the progenitor templates, and preferably at almost all of the progenitor templates. Even more preferably still a serviceable demarcation point is an area of homology that is shared by all of the progenitor templates.

In a one embodiment, the gene reassembly process is performed exhaustively in order to generate an exhaustive library. In other words, all possible ordered combinations of the nucleic acid building blocks are represented in the set of finalized chimeric nucleic acid molecules. At the same time, the assembly order (i.e. the order of assembly of each building block in the 5' to 3 sequence of each finalized chimeric nucleic acid) in each combination is by design (or non-stochastic). Because of the non-stochastic nature of the method, the possibility of unwanted side products is greatly reduced.

In another embodiment, the method provides that the gene reassembly process is performed systematically, for example to generate a systematically compartmentalized library, with compartments that can be screened systematically, e.g., one by one. In other words the invention provides that, through the selective and judicious use of specific nucleic acid building blocks, coupled with the selective and judicious use of sequentially stepped assembly reactions, an experimental design can be achieved where specific sets of progeny products are made in each of several reaction vessels. This allows a systematic examination and screening procedure to be performed. Thus, it allows a potentially very large number of progeny molecules to be examined systematically in smaller groups.

Because of its ability to perform chimerizations in a manner that is highly flexible yet exhaustive and systematic as well, particularly when there is a low level of homology among the progenitor molecules, the instant invention provides for the generation of a library (or set) comprised of a large number of progeny molecules. Because of the non-stochastic nature of the instant gene reassembly invention, the progeny molecules generated preferably comprise a library of finalized chimeric nucleic acid molecules having an overall assembly order that is chosen by design. In a particularly embodiment, such a generated library is comprised of greater than 103 to greater than 101000 different progeny molecular species.

In one aspect, a set of finalized chimeric nucleic acid molecules, produced as described is comprised of a polynucleotide encoding a polypeptide. According to one embodiment, this polynucleotide is a gene, which may be a man-made gene. According to another embodiment, this polynucleotide is a gene pathway, which may be a man-made gene pathway. The invention provides that one or more man-made genes generated by the invention may be incorporated into a man-made gene pathway, such as pathway operable in a eukaryotic organism (including a plant).

In another exemplification, the synthetic nature of the step in which the building blocks are generated allows the design and introduction of nucleotides (e.g., one or more nucleotides, which may be, for example, codons or introns or regulatory sequences) that can later be optionally removed in an in vitro process (e.g., by mutagenesis) or in an in vivo process (e.g., by utilizing the gene splicing ability of a host organism). It is appreciated that in many instances the introduction of these nucleotides may also be desirable for many other reasons in addition to the potential benefit of creating a serviceable demarcation point.

Thus, according to another embodiment, the invention provides that a nucleic acid building block can be used to introduce an intron. Thus, the invention provides that functional introns may be introduced into a man-made gene of the invention. The invention also provides that functional introns may be introduced into a man-made gene pathway of the invention. Accordingly, the invention provides for the generation of a chimeric polynucleotide that is a man-made gene containing one (or more) artificially introduced intron(s).

Accordingly, the invention also provides for the generation of a chimeric polynucleotide that is a man-made gene pathway containing one (or more) artificially introduced intron(s). Preferably, the artificially introduced intron(s) are functional in one or more host cells for gene splicing much in the way that naturally-occurring introns serve functionally in gene splicing. The invention provides a process of producing man-made intron-containing polynucleotides to be introduced into host organisms for recombination and/or splicing.

A man-made gene produced using the invention can also serve as a substrate for recombination with another nucleic acid. Likewise, a man-made gene pathway produced using the invention can also serve as a substrate for recombination with another nucleic acid. In a preferred instance, the recombination is facilitated by, or occurs at, areas of homology between the man-made, intron-containing gene and a nucleic acid, which serves as a recombination partner. In a particularly preferred instance, the recombination partner may also be a nucleic acid generated by the invention, including a man-made gene or a man-made gene pathway. Recombination may be facilitated by or may occur at areas of homology that exist at the one (or more) artificially introduced intron(s) in the man-made gene.

The synthetic gene reassembly method of the invention utilizes a plurality of nucleic acid building blocks, each of which preferably has two ligatable ends. The two ligatable ends on each nucleic acid building block may be two blunt ends (i.e. each having an overhang of zero nucleotides), or preferably one blunt end and one overhang, or more preferably still two overhangs.

A useful overhang for this purpose may be a 3' overhang or a 5' overhang. Thus, a nucleic acid building block may have a 3' overhang or alternatively a 5' overhang or alternatively two 3' overhangs or alternatively two 5' overhangs. The overall order in which the nucleic acid building blocks are assembled to form a finalized chimeric nucleic acid molecule is determined by purposeful experimental design and is not random.

According to one preferred embodiment, a nucleic acid building block is generated by chemical synthesis of two single-stranded nucleic acids (also referred to as single-stranded oligos) and contacting them so as to allow them to anneal to form a double-stranded nucleic acid building block.

A double-stranded nucleic acid building block can be of variable size. The sizes of these building blocks can be small or large. Preferred sizes for building block range from 1 base pair (not including any overhangs) to 100,000 base pairs (not including any overhangs). Other preferred size ranges are also provided, which have lower limits of from 1 bp to 10,000 bp (including every integer value in between), and upper limits of from 2 bp to 100,000 bp (including every integer value in between).

Many methods exist by which a double-stranded nucleic acid building block can be generated that is serviceable for the invention; and these are known in the art and can be readily performed by the skilled artisan.

According to one embodiment, a double-stranded nucleic acid building block is generated by first generating two single stranded nucleic acids and allowing them to anneal to form a double-stranded nucleic acid building block. The two strands of a double-stranded nucleic acid building block may be complementary at every nucleotide apart from any that form an overhang; thus containing no mismatches, apart from any overhang(s). According to another embodiment, the two strands of a double-stranded nucleic acid building block are complementary at fewer than every nucleotide apart from any that form an overhang. Thus, according to this embodiment, a double-stranded nucleic acid building block can be used to introduce codon degeneracy. Preferably the codon degeneracy is introduced using the site-saturation mutagenesis described herein, using one or more N,N,G/T cassettes or alternatively using one or more N,N,N cassettes.

The in vivo recombination method of the invention can be performed blindly on a pool of unknown hybrids or alleles of a specific polynucleotide or sequence. However, it is not necessary to know the actual DNA or RNA sequence of the specific polynucleotide.

The approach of using recombination within a mixed population of genes can be useful for the generation of any useful proteins, for example, interleukin I, antibodies, tPA and growth hormone. This approach may be used to generate proteins having altered specificity or activity. The approach may also be useful for the generation of hybrid nucleic acid sequences, for example, promoter regions, introns, exons, enhancer sequences, 31 untranslated regions or 51 untranslated regions of genes. Thus this approach may be used to generate genes having increased rates of expression. This approach may also be useful in the study of repetitive DNA sequences. Finally, this approach may be useful to mutate ribozymes or aptamers.

In one aspect the invention described herein is directed to the use of repeated cycles of reductive reassortment, recombination and selection which allow for the directed molecular evolution of highly complex linear sequences, such as DNA, RNA or proteins thorough recombination.

In vivo shuffling of molecules is useful in providing variants and can be performed utilizing the natural property of cells to recombine multimers. While recombination in vivo has provided the major natural route to molecular diversity, genetic recombination remains a relatively complex process that involves 1) the recognition of homologies; 2) strand cleavage, strand invasion, and metabolic steps leading to the production of recombinant chiasma; and finally 3) the resolution of chiasma into discrete recombined molecules. The formation of the chiasma requires the recognition of homologous sequences.

In another embodiment, the invention includes a method for producing a hybrid polynucleotide from at least a first polynucleotide and a second polynucleotide. The invention can be used to produce a hybrid polynucleotide by introducing at least a first polynucleotide and a second polynucleotide which share at least one region of partial sequence homology into a suitable host cell. The regions of partial sequence homology promote processes which result in sequence reorganization producing a hybrid polynucleotide. The term "hybrid polynucleotide", as used herein, is any nucleotide sequence which results from the method of the present invention and contains sequence from at least two original polynucleotide sequences. Such hybrid polynucleotides can result from intermolecular recombination events which promote sequence integration between DNA molecules. In addition, such hybrid polynucleotides can result from intramolecular reductive reassortment processes which utilize repeated sequences to alter a nucleotide sequence within a DNA molecule.

The invention provides a means for generating hybrid polynucleotides which may encode biologically active hybrid polypeptides (e.g., hybrid alpha amylases). In one aspect, the original polynucleotides encode biologically active polypeptides. The method of the invention produces new hybrid polypeptides by utilizing cellular processes which integrate the sequence of the original polynucleotides such that the resulting hybrid polynucleotide encodes a polypeptide demonstrating activities derived from the original biologically active polypeptides. For example, the original polynucleotides may encode a particular enzyme from different microorganisms. An enzyme encoded by a first polynucleotide from one organism or variant may, for example, function effectively under a particular environmental condition, e.g. high salinity. An enzyme encoded by a second polynucleotide from a different organism or variant may function effectively under a different environmental condition, such as extremely high temperatures. A hybrid polynucleotide containing sequences from the first and second original polynucleotides may encode an enzyme which exhibits characteristics of both enzymes encoded by the original polynucleotides. Thus, the enzyme encoded by the hybrid polynucleotide may function effectively under environmental conditions shared by each of the enzymes encoded by the first and second polynucleotides, e.g., high salinity and extreme temperatures.

Enzymes encoded by the polynucleotides of the invention include, but are not limited to, hydrolases, such as alpha amylases and alkaline amylases. A hybrid polypeptide resulting from the method of the invention may exhibit specialized enzyme activity not displayed in the original enzymes. For example, following recombination and/or reductive reassortment of polynucleotides encoding hydrolase activities, the resulting hybrid polypeptide encoded by a hybrid polynucleotide can be screened for specialized hydrolase activities obtained from each of the original enzymes, i.e. the type of bond on which the hydrolase acts and the temperature at which the hydrolase functions. Thus, for example, the hydrolase may be screened to ascertain those chemical functionalities which distinguish the hybrid hydrolase from the original hydrolases, such as: (a) amide (peptide bonds), i.e., proteases; (b) ester bonds, i.e., amylases and lipases; (c) acetals, i.e., glycosidases and, for example, the temperature, pH or salt concentration at which the hybrid polypeptide functions.

Sources of the original polynucleotides may be isolated from individual organisms ("isolates"), collections of organisms that have been grown in defined media ("enrichment cultures"), or, uncultivated organisms ("environmental samples"). The use of a culture-independent approach to derive polynucleotides encoding novel bioactivities from environmental samples is most preferable since it allows one to access untapped resources of biodiversity.

"Environmental libraries" are generated from environmental samples and represent the collective genomes of naturally occurring organisms archived in cloning vectors that can be propagated in suitable prokaryotic hosts. Because the cloned DNA is initially extracted directly from environmental samples, the libraries are not limited to the small fraction of prokaryotes that can be grown in pure culture. Additionally, a normalization of the environmental DNA present in these samples could allow more equal representation of the DNA from all of the species present in the original sample. This can dramatically increase the efficiency of finding interesting genes from minor constituents of the sample which may be under-represented by several orders of magnitude compared to the dominant species.

For example, gene libraries generated from one or more uncultivated microorganisms are screened for an activity of interest. Potential pathways encoding bioactive molecules of interest are first captured in prokaryotic cells in the form of gene expression libraries. Polynucleotides encoding activities of interest are isolated from such libraries and introduced into a host cell. The host cell is grown under conditions which promote recombination and/or reductive reassortment creating potentially active biomolecules with novel or enhanced activities.

The microorganisms from which the polynucleotide may be prepared include prokaryotic microorganisms, such as Eubacteria and Archaebacteria, and lower eukaryotic microorganisms such as fungi, some algae and protozoa. Polynucleotides may be isolated from environmental samples in which case the nucleic acid may be recovered without culturing of an organism or recovered from one or more cultured organisms. In one aspect, such microorganisms may be extremophiles, such as hyperthermophiles, psychrophiles, psychrotrophs, halophiles, barophiles and acidophiles. Polynucleotides encoding enzymes isolated from extremophilic microorganisms are particularly preferred. Such enzymes may function at temperatures above 100° C. in terrestrial hot springs and deep sea thermal vents, at temperatures below 0° C. in arctic waters, in the saturated salt environment of the Dead Sea, at pH values around 0 in coal deposits and geothermal sulfur-rich springs, or at pH values greater than 11 in sewage sludge. For example, several amylases and lipases cloned and expressed from extremophilic organisms show high activity throughout a wide range of temperatures and pHs.

Of the novel enzymes of the present invention, many have been purified and characterized at pH 8, at both 40° C. and 50° C., and pH 10 at both 40° C. and 50° C. of the enzymes found to be purified and characterized at pH 8 and 40° C., was seen to have three times (682 U/mg) the specific activity of a *B. licheniformis* enzyme (228 U/mg). Additionally, another enzyme was seen to have approximately equivalent activity (250U/mg) to the *B. licheniformis* enzyme. At a pH 10 and 50° C., one of the enzymes has a specific activity of 31 U/mg and another has a specific activity of 27.5 U/mg, while *B. licheniformis* has a specific activity of 27 U/mg.

Polynucleotides selected and isolated as hereinabove described are introduced into a suitable host cell. A suitable host cell is any cell which is capable of promoting recombination and/or reductive reassortment. The selected polynucleotides are preferably already in a vector which includes appropriate control sequences. The host cell can be a higher eukaryotic cell, such as a mammalian cell, or a lower eukaryotic cell, such as a yeast cell, or preferably, the host cell can be a prokaryotic cell, such as a bacterial cell. Introduction of the construct into the host cell can be effected by calcium phosphate transfection, DEAE-Dextran mediated transfection, or electroporation (Davis et al., 1986).

As representative examples of appropriate hosts, there may be mentioned: bacterial cells, such as *E. coli, Streptomyces, Salmonella typhimurium*; fungal cells, such as yeast; insect cells such as *Drosophila* S2 and *Spodoptera* Sf9; animal cells such as CHO, COS or Bowes melanoma; adenoviruses; and plant cells. The selection of an appropriate host is deemed to be within the scope of those skilled in the art from the teachings herein.

With particular references to various mammalian cell culture systems that can be employed to express recombinant protein, examples of mammalian expression systems include the COS-7 lines of monkey kidney fibroblasts, described in "SV40-transformed simian cells support the replication of early SV40 mutants" (Gluzman, 1981), and other cell lines capable of expressing a compatible vector, for example, the C127, 3T3, CHO, HeLa and BHK cell lines. Mammalian expression vectors will comprise an origin of replication, a suitable promoter and enhancer, and also any necessary ribosome binding sites, polyadenylation site, splice donor and acceptor sites, transcriptional termination sequences, and 5' flanking nontranscribed sequences. DNA sequences derived from the SV40 splice, and polyadenylation sites may be used to provide the required nontranscribed genetic elements.

Host cells containing the polynucleotides of interest can be cultured in conventional nutrient media modified as appropriate for activating promoters, selecting transformants or amplifying genes. The culture conditions, such as temperature, pH and the like, are those previously used with the host cell selected for expression, and will be apparent to the ordinarily skilled artisan. The clones which are identified as having the specified enzyme activity may then be sequenced to identify the polynucleotide sequence encoding an enzyme having the enhanced activity.

In another aspect, it is envisioned the method of the present invention can be used to generate novel polynucleotides encoding biochemical pathways from one or more operons or gene clusters or portions thereof. For example, bacteria and many eukaryotes have a coordinated mechanism for regulating genes whose products are involved in related processes. The genes are clustered, in structures referred to as "gene clusters," on a single chromosome and are transcribed together under the control of a single regulatory sequence, including a single promoter which initiates transcription of the entire cluster. Thus, a gene cluster is a group of adjacent genes that are either identical or related, usually as to their function. An example of a biochemical pathway encoded by gene clusters are polyketides. Polyketides are molecules which are an extremely rich source of bioactivities, including antibiotics (such as tetracyclines and erythromycin), anti-cancer agents (daunomycin), immunosuppressants (FK506 and rapamycin), and veterinary products (monensin). Many polyketides (produced by polyketide synthases) are valuable as therapeutic agents. Polyketide synthases are multifunctional enzymes that catalyze the biosynthesis of an enormous variety of carbon chains differing in length and patterns of functionality and cyclization. Polyketide synthase genes fall into gene clusters and at least one type (designated type I) of polyketide synthases have large size genes and enzymes, complicating genetic manipulation and in vitro studies of these genes/proteins.

Gene cluster DNA can be isolated from different organisms and ligated into vectors, particularly vectors containing expression regulatory sequences which can control and regulate the production of a detectable protein or protein-related array activity from the ligated gene clusters. Use of vectors which have an exceptionally large capacity for exogenous DNA introduction are particularly appropriate for use with such gene clusters and are described by way of example herein to include the f-factor (or fertility factor) of *E. coli*. This f-factor of *E. coli* is a plasmid which affect high-frequency transfer of itself during conjugation and is ideal to achieve and stably propagate large DNA fragments, such as gene clusters from mixed microbial samples. A particularly preferred embodiment is to use cloning vectors, referred to as "fosmids" or bacterial artificial chromosome (BAC) vectors. These are derived from *E. coli* f-factor which is able to stably integrate large segments of genomic DNA. When integrated with DNA from a mixed uncultured environmental sample, this makes it possible to achieve large genomic fragments in the form of a stable "environmental DNA library." Another type of vector for use in the present invention is a cosmid vector. Cosmid vectors were originally designed to clone and propagate large segments of genomic DNA. Cloning into cosmid vectors is described in detail in Sambrook et al., Molecular Cloning: A Laboratory Manual, 2nd Ed., Cold Spring Harbor Laboratory Press (1989). Once ligated into an appropriate vector, two or more vectors containing different polyketide synthase gene clusters can be introduced into a suitable host cell. Regions of partial sequence homology shared by the gene clusters will promote processes which result in sequence reorganization resulting in a hybrid gene cluster. The novel hybrid gene cluster can then be screened for enhanced activities not found in the original gene clusters.

Therefore, in a one embodiment, the invention relates to a method for producing a biologically active hybrid polypeptide and screening such a polypeptide for enhanced activity by:

1) introducing at least a first polynucleotide in operable linkage and a second polynucleotide in operable linkage, said at least first polynucleotide and second polynucleotide sharing at least one region of partial sequence homology, into a suitable host cell;

2) growing the host cell under conditions which promote sequence reorganization resulting in a hybrid polynucleotide in operable linkage;

3) expressing a hybrid polypeptide encoded by the hybrid polynucleotide;

4) screening the hybrid polypeptide under conditions which promote identification of enhanced biological activity; and 5) isolating the a polynucleotide encoding the hybrid polypeptide.

Methods for screening for various enzyme activities are known to those of skill in the art and are discussed throughout the present specification. Such methods may be employed when isolating the polypeptides and polynucleotides of the invention.

As representative examples of expression vectors which may be used, there may be mentioned viral particles, baculovirus, phage, plasmids, phagemids, cosmids, fosmids, bacterial artificial chromosomes, viral DNA (e.g., vaccinia, adenovirus, foul pox virus, pseudorabies and derivatives of SV40), P1-based artificial chromosomes, yeast plasmids, yeast artificial chromosomes, and any other vectors specific for specific hosts of interest (such as bacillus, aspergillus and yeast). Thus, for example, the DNA may be included in any one of a variety of expression vectors for expressing a polypeptide. Such vectors include chromosomal, nonchromosomal and synthetic DNA sequences. Large numbers of suitable vectors are known to those of skill in the art, and are commercially available. The following vectors are provided by way of example; Bacterial: pQE vectors (Qiagen), pBluescript plasmids, pNH vectors, (lambda-ZAP vectors (Stratagene); ptrc99a, pKK223-3, pDR540, pRIT2T (Pharmacia); Eukaryotic: pXTI, pSG5 (Stratagene), pSVK3, pBPV, pMSG, pSVLSV40 (Pharmacia). However, any other plasmid or other vector may be used so long as they are replicable and viable in the host. Low copy number or high copy number vectors may be employed with the present invention.

The DNA sequence in the expression vector is operatively linked to an appropriate expression control sequence(s) (promoter) to direct RNA synthesis. Particular named bacterial promoters include lacI, lacZ, T3, T7, gpt, lambda PR, PL and trp. Eukaryotic promoters include CMV immediate early, HSV thymidine kinase, early and late SV40, LTRs from retrovirus, and mouse metallothionein-I. Selection of the appropriate vector and promoter is well within the level of ordinary skill in the art. The expression vector also contains a ribosome binding site for translation initiation and a transcription terminator. The vector may also include appropriate sequences for amplifying expression. Promoter regions can be selected from any desired gene using chloramphenicol transferase (CAT) vectors or other vectors with selectable markers. In addition, the expression vectors preferably contain one or more selectable marker genes to provide a phenotypic trait for selection of transformed host cells such as dihydrofolate reductase or neomycin resistance for eukaryotic cell culture, or such as tetracycline or ampicillin resistance in *E. coli*.

In vivo reassortment is focused on "inter-molecular" processes collectively referred to as "recombination" which in bacteria, is generally viewed as a "RecA-dependent" phenomenon. The invention can rely on recombination processes of a host cell to recombine and re-assort sequences, or the cells' ability to mediate reductive processes to decrease the complexity of quasi-repeated sequences in the cell by deletion. This process of "reductive reassortment" occurs by an "intra-molecular", RecA-independent process.

Therefore, in another aspect of the invention, novel polynucleotides can be generated by the process of reductive reassortment. The method involves the generation of constructs containing consecutive sequences (original encoding sequences), their insertion into an appropriate vector, and their subsequent introduction into an appropriate host cell. The reassortment of the individual molecular identities occurs by combinatorial processes between the consecutive sequences in the construct possessing regions of homology, or between quasi-repeated units. The reassortment process recombines and/or reduces the complexity and extent of the repeated sequences, and results in the production of novel molecular species. Various treatments may be applied to enhance the rate of reassortment. These could include treatment with ultra-violet light, or DNA damaging chemicals, and/or the use of host cell lines displaying enhanced levels of "genetic instability". Thus the reassortment process may involve homologous recombination or the natural property of quasi-repeated sequences to direct their own evolution.

Repeated or "quasi-repeated" sequences play a role in genetic instability. In the present invention, "quasi-repeats" are repeats that are not restricted to their original unit structure. Quasi-repeated units can be presented as an array of sequences in a construct; consecutive units of similar sequences. Once ligated, the junctions between the consecutive sequences become essentially invisible and the quasi-repetitive nature of the resulting construct is now continuous at the molecular level. The deletion process the cell performs to reduce the complexity of the resulting construct operates between the quasi-repeated sequences. The quasi-repeated units provide a practically limitless repertoire of templates upon which slippage events can occur. The constructs containing the quasi-repeats thus effectively provide sufficient molecular elasticity that deletion (and potentially insertion) events can occur virtually anywhere within the quasi-repetitive units.

When the quasi-repeated sequences are all ligated in the same orientation, for instance head to tail or vice versa, the cell cannot distinguish individual units. Consequently, the reductive process can occur throughout the sequences. In contrast, when for example, the units are presented head to head, rather than head to tail, the inversion delineates the endpoints of the adjacent unit so that deletion formation will favor the loss of discrete units. Thus, it is preferable with the present method that the sequences are in the same orientation. Random orientation of quasi-repeated sequences will result in the loss of reassortment efficiency, while consistent orientation of the sequences will offer the highest efficiency. However, while having fewer of the contiguous sequences in the same orientation decreases the efficiency, it may still provide sufficient elasticity for the effective recovery of novel molecules. Constructs can be made with the quasi-repeated sequences in the same orientation to allow higher efficiency.

Sequences can be assembled in a head to tail orientation using any of a variety of methods, including the following:

a) Primers that include a poly-A head and poly-T tail which when made single-stranded would provide orientation can be utilized. This is accomplished by having the first few bases of the primers made from RNA and hence easily removed RNAseH.

b) Primers that include unique restriction cleavage sites can be utilized. Multiple sites, a battery of unique sequences, and repeated synthesis and ligation steps would be required.

c) The inner few bases of the primer could be thiolated and an exonuclease used to produce properly tailed molecules.

The recovery of the re-assorted sequences relies on the identification of cloning vectors with a reduced repetitive index (RI). The re-assorted encoding sequences can then be recovered by amplification. The products are re-cloned and expressed. The recovery of cloning vectors with reduced RI can be affected by:

1) The use of vectors only stably maintained when the construct is reduced in complexity.

2) The physical recovery of shortened vectors by physical procedures. In this case, the cloning vector would be recovered using standard plasmid isolation procedures and size fractionated on either an agarose gel, or column with a low molecular weight cut off utilizing standard procedures.

3) The recovery of vectors containing interrupted genes which can be selected when insert size decreases.

4) The use of direct selection techniques with an expression vector and the appropriate selection.

Encoding sequences (for example, genes) from related organisms may demonstrate a high degree of homology and encode quite diverse protein products. These types of sequences are particularly useful in the present invention as quasi-repeats. However, while the examples illustrated below demonstrate the reassortment of nearly identical original encoding sequences (quasi-repeats), this process is not limited to such nearly identical repeats.

The following example demonstrates a method of the invention. Encoding nucleic acid sequences (quasi-repeats) derived from three (3) unique species are described. Each sequence encodes a protein with a distinct set of properties. Each of the sequences differs by a single or a few base pairs at a unique position in the sequence. The quasi-repeated sequences are separately or collectively amplified and ligated into random assemblies such that all possible permutations and combinations are available in the population of ligated molecules. The number of quasi-repeat units can be controlled by the assembly conditions. The average number of quasi-repeated units in a construct is defined as the repetitive index (RI).

Once formed, the constructs may, or may not be size fractionated on an agarose gel according to published protocols, inserted into a cloning vector, and transfected into an appropriate host cell. The cells are then propagated and "reductive reassortment" is effected. The rate of the reductive reassortment process may be stimulated by the introduction of DNA damage if desired. Whether the reduction in RI is mediated by deletion formation between repeated sequences by an "intra-molecular" mechanism, or mediated by recombination-like events through "inter-molecular" mechanisms is immaterial. The end result is a reassortment of the molecules into all possible combinations.

Optionally, the method comprises the additional step of screening the library members of the shuffled pool to identify individual shuffled library members having the ability to bind or otherwise interact, or catalyze a particular reaction (e.g., such as catalytic domain of an enzyme) with a predetermined macromolecule, such as for example a proteinaceous receptor, an oligosaccharide, viron, or other predetermined compound or structure.

The polypeptides that are identified from such libraries can be used for therapeutic, diagnostic, research and related purposes (e.g., catalysts, solutes for increasing osmolarity of an aqueous solution, and the like), and/or can be subjected to one or more additional cycles of shuffling and/or selection.

In another aspect, it is envisioned that prior to or during recombination or reassortment, polynucleotides generated by the method of the invention can be subjected to agents or processes which promote the introduction of mutations into the original polynucleotides. The introduction of such mutations would increase the diversity of resulting hybrid polynucleotides and polypeptides encoded therefrom. The agents or processes which promote mutagenesis can include, but are not limited to: (+)-CC-1065, or a synthetic analog such as (+)-CC-1065-(N3-Adenine (See Sun and Hurley, (1992); an N-acelylated or deacetylated 4'-fluro-4-aminobiphenyl adduct capable of inhibiting DNA synthesis (See, for example, van de Poll et al. (1992)); or a N-acetylated or deacetylated 4-aminobiphenyl adduct capable of inhibiting DNA synthesis (See also, van de Poll et al. (1992), pp. 751-758); trivalent chromium, a trivalent chromium salt, a polycyclic aromatic hydrocarbon (PAH) DNA adduct capable of inhibiting DNA replication, such as 7-bromomethyl-benz[a]anthracene ("BMA"), tris(2,3-dibromopropyl)phosphate ("Tris-BP"), 1,2-dibromo-3-chloropropane ("DBCP"), 2-bromoacrolein (2BA), benzo[a]pyrene-7,8-dihydrodiol-9-10-epoxide ("BPDE"), a platinum(II) halogen salt, N-hydroxy-2-amino-3-methylimidazo[4,5-f]-quinoline ("N-hydroxy-IQ"), and N-hydroxy-2-amino-1-methyl-6-phenylimidazo[4,5-f]-pyridine ("N-hydroxy-PhIP"). Especially preferred means for slowing or halting PCR amplification consist of UV light (+)-CC-1065 and (+)-CC-1065-(N3-Adenine). Particularly encompassed means are DNA adducts or polynucleotides comprising the DNA adducts from the polynucleotides or polynucleotides pool, which can be released or removed by a process including heating the solution comprising the polynucleotides prior to further processing.

In another aspect the invention is directed to a method of producing recombinant proteins having biological activity by treating a sample comprising double-stranded template polynucleotides encoding a wild-type protein under conditions according to the invention which provide for the production of hybrid or re-assorted polynucleotides.

The invention also provides for the use of proprietary codon primers (containing a degenerate N,N,N sequence) to introduce point mutations into a polynucleotide, so as to generate a set of progeny polypeptides in which a full range of single amino acid substitutions is represented at each amino acid position (gene site saturated mutagenesis (GSSM)). The oligos used are comprised contiguously of a first homologous sequence, a degenerate N,N,N sequence, and preferably but not necessarily a second homologous sequence. The downstream progeny translational products from the use of such oligos include all possible amino acid changes at each amino acid site along the polypeptide, because the degeneracy of the N,N,N sequence includes codons for all 20 amino acids.

In one aspect, one such degenerate oligo (comprised of one degenerate N,N,N cassette) is used for subjecting each original codon in a parental polynucleotide template to a full range of codon substitutions. In another aspect, at least two degenerate N,N,N cassettes are used—either in the same oligo or not, for subjecting at least two original codons in a parental polynucleotide template to a full range of codon substitutions. Thus, more than one N,N,N sequence can be contained in one oligo to introduce amino acid mutations at more than one site. This plurality of N,N,N sequences can be directly contiguous, or separated by one or more additional nucleotide sequence(s). In another aspect, oligos serviceable for introducing additions and deletions can be used either alone or in combination with the codons containing an N,N,N sequence, to introduce any combination or permutation of amino acid additions, deletions, and/or substitutions.

In a particular exemplification, it is possible to simultaneously mutagenize two or more contiguous amino acid positions using an oligo that contains contiguous N,N,N triplets, i.e. a degenerate (N,N,N)n sequence.

In another aspect, the present invention provides for the use of degenerate cassettes having less degeneracy than the N,N,N sequence. For example, it may be desirable in some instances to use (e.g. in an oligo) a degenerate triplet sequence comprised of only one N, where said N can be in the first second or third position of the triplet. Any other bases including any combinations and permutations thereof can be used in the remaining two positions of the triplet. Alternatively, it may be desirable in some instances to use (e.g., in an oligo) a degenerate N,N,N triplet sequence, N,N,G/T, or an N,N, G/C triplet sequence.

It is appreciated, however, that the use of a degenerate triplet (such as N,N,G/T or an N,N, G/C triplet sequence) as disclosed in the instant invention is advantageous for several reasons. In one aspect, this invention provides a means to systematically and fairly easily generate the substitution of the full range of possible amino acids (for a total of 20 amino acids) into each and every amino acid position in a polypeptide. Thus, for a 100 amino acid polypeptide, the invention provides a way to systematically and fairly easily generate 2000 distinct species (i.e., 20 possible amino acids per position times 100 amino acid positions). It is appreciated that there is provided, through the use of an oligo containing a degenerate N,N,G/T or an N,N, G/C triplet sequence, 32 individual sequences that code for 20 possible amino acids. Thus, in a reaction vessel in which a parental polynucleotide sequence is subjected to saturation mutagenesis using one such oligo, there are generated 32 distinct progeny polynucleotides encoding 20 distinct polypeptides. In contrast, the use of a non-degenerate oligo in site-directed mutagenesis leads to only one progeny polypeptide product per reaction vessel.

This invention also provides for the use of nondegenerate oligos, which can optionally be used in combination with degenerate primers disclosed. It is appreciated that in some situations, it is advantageous to use nondegenerate oligos to generate specific point mutations in a working polynucleotide. This provides a means to generate specific silent point mutations, point mutations leading to corresponding amino acid changes, and point mutations that cause the generation of stop codons and the corresponding expression of polypeptide fragments.

Thus, in a preferred embodiment of this invention, each saturation mutagenesis reaction vessel contains polynucleotides encoding at least 20 progeny polypeptide molecules such that all 20 amino acids are represented at the one specific amino acid position corresponding to the codon position mutagenized in the parental polynucleotide. The 32-fold degenerate progeny polypeptides generated from each saturation mutagenesis reaction vessel can be subjected to clonal amplification (e.g., cloned into a suitable E. coli host using an expression vector) and subjected to expression screening. When an individual progeny polypeptide is identified by screening to display a favorable change in property (when compared to the parental polypeptide), it can be sequenced to identify the correspondingly favorable amino acid substitution contained therein.

It is appreciated that upon mutagenizing each and every amino acid position in a parental polypeptide using saturation mutagenesis as disclosed herein, favorable amino acid changes may be identified at more than one amino acid position. One or more new progeny molecules can be generated that contain a combination of all or part of these favorable amino acid substitutions. For example, if 2 specific favorable amino acid changes are identified in each of 3 amino acid positions in a polypeptide, the permutations include 3 possibilities at each position (no change from the original amino acid, and each of two favorable changes) and 3 positions. Thus, there are 3×3×3 or 27 total possibilities, including 7 that were previously examined—6 single point mutations (i.e., 2 at each of three positions) and no change at any position.

In yet another aspect, site-saturation mutagenesis can be used together with shuffling, chimerization, recombination and other mutagenizing processes, along with screening. This invention provides for the use of any mutagenizing process (es), including saturation mutagenesis, in an iterative manner. In one exemplification, the iterative use of any mutagenizing process(es) is used in combination with screening.

Thus, in a non-limiting exemplification, this invention provides for the use of saturation mutagenesis in combination with additional mutagenization processes, such as process where two or more related polynucleotides are introduced into a suitable host cell such that a hybrid polynucleotide is generated by recombination and reductive reassortment.

In addition to performing mutagenesis along the entire sequence of a gene, the instant invention provides that mutagenesis can be use to replace each of any number of bases in a polynucleotide sequence, wherein the number of bases to be mutagenized is preferably every integer from 15 to 100,000. Thus, instead of mutagenizing every position along a molecule, one can subject every or a discrete number of bases (preferably a subset totaling from 15 to 100,000) to mutagenesis. Preferably, a separate nucleotide is used for mutagenizing each position or group of positions along a polynucleotide sequence. A group of 3 positions to be mutagenized may be a codon. The mutations are preferably introduced using a mutagenic primer, containing a heterologous cassette, also referred to as a mutagenic cassette. Preferred cassettes can have from 1 to 500 bases. Each nucleotide position in such heterologous cassettes be N, A, C, G, T, A/C, A/G, A/T, C/G, C/T, G/T, C/G/T, A/G/T, A/C/T, A/C/G, or E, where E is any base that is not A, C, G, or T (E can be referred to as a designer oligo).

In a general sense, saturation mutagenesis is comprised of mutagenizing a complete set of mutagenic cassettes (wherein each cassette is preferably about 1-500 bases in length) in defined polynucleotide sequence to be mutagenized (wherein the sequence to be mutagenized is preferably from about 15 to 100,000 bases in length). Thus, a group of mutations (ranging from 1 to 100 mutations) is introduced into each cassette to be mutagenized. A grouping of mutations to be introduced into one cassette can be different or the same from a second grouping of mutations to be introduced into a second cassette during the application of one round of saturation mutagenesis. Such groupings are exemplified by deletions, additions, groupings of particular codons, and groupings of particular nucleotide cassettes.

Defined sequences to be mutagenized include a whole gene, pathway, cDNA, an entire open reading frame (ORF), and entire promoter, enhancer, repressor/transactivator, origin of replication, intron, operator, or any polynucleotide functional group. Generally, a "defined sequences" for this purpose may be any polynucleotide that a 15 base-polynucleotide sequence, and polynucleotide sequences of lengths between 15 bases and 15,000 bases (this invention specifically names every integer in between). Considerations in choosing groupings of codons include types of amino acids encoded by a degenerate mutagenic cassette.

In a particularly preferred exemplification a grouping of mutations that can be introduced into a mutagenic cassette, this invention specifically provides for degenerate codon substitutions (using degenerate oligos) that code for 2, 3, 4, 5, 6, 7, 8, 9, 10, 11, 12, 13, 14, 15, 16, 17, 18, 19, and 20 amino acids at each position, and a library of polypeptides encoded thereby.

One aspect of the invention is an isolated nucleic acid comprising one of the sequences of Group A nucleic acid sequences, and sequences substantially identical thereto, the sequences complementary thereto, or a fragment comprising at least 10, 15, 20, 25, 30, 35, 40, 50, 75, 100, 150, 200, 300, 400, or 500 consecutive bases of one of the sequences of a Group A nucleic acid sequence (or the sequences complementary thereto). The isolated, nucleic acids may comprise DNA, including cDNA, genomic DNA, and synthetic DNA. The DNA may be double-stranded or single-stranded, and if single stranded may be the coding strand or non-coding (antisense) strand. Alternatively, the isolated nucleic acids may comprise RNA.

As discussed in more detail below, the isolated nucleic acids of one of the Group A nucleic acid sequences, and sequences substantially identical thereto, may be used to prepare one of the polypeptides of a Group B amino acid sequence, and sequences substantially identical thereto, or fragments comprising at least 5, 10, 15, 20, 25, 30, 35, 40, 50, 75, 100, or 150 consecutive amino acids of one of the polypeptides of Group B amino acid sequences, and sequences substantially identical thereto.

Accordingly, another aspect of the invention is an isolated nucleic acid which encodes one of the polypeptides of Group B amino acid sequences, and sequences substantially identical thereto, or fragments comprising at least 5, 10, 15, 20, 25, 30, 35, 40, 50, 75,100, or 150 consecutive amino acids of one of the polypeptides of the Group B amino acid sequences. The coding sequences of these nucleic acids may be identical to one of the coding sequences of one of the nucleic acids of Group A nucleic acid sequences, or a fragment thereof or may be different coding sequences which encode one of the polypeptides of Group B amino acid sequences, sequences substantially identical thereto, and fragments having at least 5, 10, 15, 20, 25, 30, 35, 40, 50, 75, 100, or 150 consecutive amino acids of one of the polypeptides of Group B amino acid sequences, as a result of the redundancy or degeneracy of the genetic code. The genetic code is well known to those of skill in the art and can be obtained, for example, on page 214 of B. Lewin, Genes VI, Oxford University Press, 1997, the disclosure of which is incorporated herein by reference.

The isolated nucleic acid which encodes one of the polypeptides of Group B amino acid sequences, and sequences substantially identical thereto, may include, but is not limited to: only the coding sequence of one of Group A nucleic acid sequences, and sequences substantially identical thereto, and additional coding sequences, such as leader sequences or proprotein sequences and non-coding sequences, such as introns or non-coding sequences 5' and/or 3' of the coding sequence. Thus, as used herein, the term "polynucleotide encoding a polypeptide" encompasses a polynucleotide which includes only the coding sequence for the polypeptide as well as a polynucleotide which includes additional coding and/or non-coding sequence.

Alternatively, the nucleic acid sequences of Group A nucleic acid sequences, and sequences substantially identical thereto, may be mutagenized using conventional techniques, such as site directed mutagenesis, or other techniques familiar to those skilled in the art, to introduce silent changes into the polynucleotides of Group A nucleic acid sequences, and sequences substantially identical thereto. As used herein, "silent changes" include, for example, changes which do not alter the amino acid sequence encoded by the polynucleotide. Such changes may be desirable in order to increase the level of the polypeptide produced by host cells containing a vector encoding the polypeptide by introducing codons or codon pairs which occur frequently in the host organism.

The invention also relates to polynucleotides which have nucleotide changes which result in amino acid substitutions, additions, deletions, fusions and truncations in the polypeptides of Group B amino acid sequences, and sequences substantially identical thereto. Such nucleotide changes may be introduced using techniques such as site directed mutagenesis, random chemical mutagenesis, exonuclease III deletion, and other recombinant DNA techniques. Alternatively, such nucleotide changes may be naturally occurring allelic variants which are isolated by identifying nucleic acids which specifically hybridize to probes comprising at least 10, 15, 20, 25, 30, 35, 40, 50, 75, 100, 150, 200, 300, 400, or 500 consecutive bases of one of the sequences of Group A nucleic acid sequences, and sequences substantially identical thereto (or the sequences complementary thereto) under conditions of high, moderate, or low stringency as provided herein.

The isolated nucleic acids of Group A nucleic acid sequences, and sequences substantially identical thereto, the sequences complementary thereto, or a fragment comprising at least 10, 15, 20, 25, 30, 35, 40, 50, 75, 100, 150, 200, 300, 400, or 500 consecutive bases of one of the sequences of Group A nucleic acid sequences, and sequences substantially identical thereto, or the sequences complementary thereto may also be used as probes to determine whether a biological sample, such as a soil sample, contains an organism having a nucleic acid sequence of the invention or an organism from which the nucleic acid was obtained. In such procedures, a biological sample potentially harboring the organism from which the nucleic acid was isolated is obtained and nucleic acids are obtained from the sample. The nucleic acids are contacted with the probe under conditions which permit the probe to specifically hybridize to any complementary sequences from which are present therein.

Where necessary, conditions which permit the probe to specifically hybridize to complementary sequences may be determined by placing the probe in contact with complementary sequences from samples known to contain the complementary sequence as well as control sequences which do not contain the complementary sequence. Hybridization conditions, such as the salt concentration of the hybridization buffer, the formamide concentration of the hybridization buffer, or the hybridization temperature, may be varied to identify conditions which allow the probe to hybridize specifically to complementary nucleic acids.

If the sample contains the organism from which the nucleic acid was isolated, specific hybridization of the probe is then detected. Hybridization may be detected by labeling the probe with a detectable agent such as a radioactive isotope, a fluorescent dye or an enzyme capable of catalyzing the formation of a detectable product.

Many methods for using the labeled probes to detect the presence of complementary nucleic acids in a sample are familiar to those skilled in the art. These include Southern Blots, Northern Blots, colony hybridization procedures, and dot blots. Protocols for each of these procedures are provided in Ausubel et al. Current Protocols in Molecular Biology, John Wiley 503 Sons, Inc. (1997) and Sambrook et al., Molecular Cloning: A Laboratory Manual 2nd Ed., Cold Spring Harbor Laboratory Press (1989), the entire disclosures of which are incorporated herein by reference.

Alternatively, more than one probe (at least one of which is capable of specifically hybridizing to any complementary sequences which are present in the nucleic acid sample), may be used in an amplification reaction to determine whether the sample contains an organism containing a nucleic acid sequence of the invention (e.g., an organism from which the nucleic acid was isolated). Typically, the probes comprise oligonucleotides. In one embodiment, the amplification reaction may comprise a PCR reaction. PCR protocols are described in Ausubel and Sambrook, supra. Alternatively, the amplification may comprise a ligase chain reaction, 3SR, or strand displacement reaction. (See Barany, F., "The Ligase Chain Reaction in a PCR World", PCR Methods and Applications 1:5-16, 1991; E. Fahy et al., "Self-sustained Sequence Replication (3SR): An Isothermal Transcription-based Amplification System Alternative to PCR", PCR Methods and Applications 1:25-33, 1991; and Walker G. T. et al., "Strand Displacement Amplification-an Isothermal in vitro DNA Amplification Technique", Nucleic Acid Research 20:1691-1696, 1992, the disclosures of which are incorporated herein by reference in their entireties). In such procedures, the nucleic acids in the sample are contacted with the probes, the amplification reaction is performed, and any resulting amplification product is detected. The amplification product may be detected by performing gel electrophoresis on the reaction products and staining the gel with an intercalator such as ethidium bromide. Alternatively, one or more of the probes may be labeled with a radioactive isotope and the presence of a radioactive amplification product may be detected by autoradiography after gel electrophoresis.

Probes derived from sequences near the ends of the sequences of Group A nucleic acid sequences, and sequences substantially identical thereto, may also be used in chromosome walking procedures to identify clones containing genomic sequences located adjacent to the sequences of Group A nucleic acid sequences, and sequences substantially identical thereto. Such methods allow the isolation of genes which encode additional proteins from the host organism.

The isolated nucleic acids of Group A nucleic acid sequences, and sequences substantially identical thereto, the sequences complementary thereto, or a fragment comprising at least 10, 15, 20, 25, 30, 35, 40, 50, 75, 100, 150, 200, 300, 400, or 500 consecutive bases of one of the sequences of Group A nucleic acid sequences, and sequences substantially identical thereto, or the sequences complementary thereto may be used as probes to identify and isolate related nucleic acids. In some embodiments, the related nucleic acids may be cDNAs or genomic DNAs from organisms other than the one from which the nucleic acid was isolated. For example, the other organisms may be related organisms. In such procedures, a nucleic acid sample is contacted with the probe under conditions which permit the probe to specifically hybridize to related sequences. Hybridization of the probe to nucleic acids from the related organism is then detected using any of the methods described above.

In nucleic acid hybridization reactions, the conditions used to achieve a particular level of stringency will vary, depending on the nature of the nucleic acids being hybridized. For example, the length, degree of complementarity, nucleotide sequence composition (e.g., GC v. AT content), and nucleic acid type (e.g., RNA v. DNA) of the hybridizing regions of the nucleic acids can be considered in selecting hybridization conditions. An additional consideration is whether one of the nucleic acids is immobilized, for example, on a filter.

Hybridization may be carried out under conditions of low stringency, moderate stringency or high stringency. As an example of nucleic acid hybridization, a polymer membrane containing immobilized denatured nucleic acids is first prehybridized for 30 minutes at 45° C. in a solution consisting of 0.9 M NaCl, 50 mM NaH2PO4, pH 7.0, 5.0 mM Na2EDTA, 0.5% SDS, 10× Denhardt's, and 0.5 mg/ml polyriboadenylic acid. Approximately $2 \times 10^7$ cpm (specific activity $4-9 \times 10^8$ cpm/ug) of $^{32}P$ end-labeled oligonucleotide probe are then added to the solution. After 12-16 hours of incubation, the membrane is washed for 30 minutes at room temperature in 1×SET (150 mM NaCl, 20 mM Tris hydrochloride, pH 7.8, 1 mM Na2EDTA) containing 0.5% SDS, followed by a 30 minute wash in fresh 1×SET at Tm−10° C. for the oligonucleotide probe. The membrane is then exposed to auto-radiographic film for detection of hybridization signals.

By varying the stringency of the hybridization conditions used to identify nucleic acids, such as cDNAs or genomic DNAs, which hybridize to the detectable probe, nucleic acids having different levels of homology to the probe can be identified and isolated. Stringency may be varied by conducting the hybridization at varying temperatures below the melting temperatures of the probes. The melting temperature, Tm, is the temperature (under defined ionic strength and pH) at which 50% of the target sequence hybridizes to a perfectly complementary probe. Very stringent conditions are selected to be equal to or about 5° C. lower than the Tm for a particular probe. The melting temperature of the probe may be calculated using the following formulas:

For probes between 14 and 70 nucleotides in length the melting temperature (Tm) is calculated using the formula: Tm=81.5+16.6(log [Na+])+0.41(fraction G+C)−(600/N) where N is the length of the probe.

If the hybridization is carried out in a solution containing formamide, the melting temperature may be calculated using the equation: Tm=81.5+16.6(log [Na+])+0.41(fraction G+C)−(0.63% formamide)−(600/N) where N is the length of the probe.

Prehybridization may be carried out in 6×SSC, 5× Denhardt's reagent, 0.5% SDS, 100 μg denatured fragmented salmon sperm DNA or 6×SSC, 5× Denhardt's reagent, 0.5% SDS, 100 μg denatured fragmented salmon sperm DNA, 50% formamide. The formulas for SSC and Denhardt's solutions are listed in Sambrook et al., supra.

Hybridization is conducted by adding the detectable probe to the prehybridization solutions listed above. Where the probe comprises double stranded DNA, it is denatured before addition to the hybridization solution. The filter is contacted with the hybridization solution for a sufficient period of time to allow the probe to hybridize to cDNAs or genomic DNAs containing sequences complementary thereto or homologous thereto. For probes over 200 nucleotides in length, the hybridization may be carried out at 15-25° C. below the Tm. For shorter probes, such as oligonucleotide probes, the hybridization may be conducted at 5-10° C. below the Tm. Typically, for hybridizations in 6×SSC, the hybridization is conducted at approximately 68° C. Usually, for hybridizations in 50% formamide containing solutions, the hybridization is conducted at approximately 42° C.

All of the foregoing hybridizations would be considered to be under conditions of high stringency.

Following hybridization, the filter is washed to remove any non-specifically bound detectable probe. The stringency used to wash the filters can also be varied depending on the nature of the nucleic acids being hybridized, the length of the nucleic acids being hybridized, the degree of complementarity, the nucleotide sequence composition (e.g., GC v. AT content), and the nucleic acid type (e.g., RNA v. DNA). Examples of progressively higher stringency condition washes are as follows: 2×SSC, 0.1% SDS at room temperature for 15 minutes (low stringency); 0.1×SSC, 0.5% SDS at room temperature for 30 minutes to 1 hour (moderate stringency); 0.1×SSC, 0.5% SDS for 15 to 30 minutes at between the hybridization temperature and 68° C. (high stringency); and 0.1 SM NaCl for 15 minutes at 72° C. (very high stringency). A final low stringency wash can be conducted in 0.1×SSC at room temperature. The examples above are merely illustrative of one set of conditions that can be used to wash filters. One of skill in the art would know that there are numerous recipes for different stringency washes. Some other examples are given below.

Nucleic acids which have hybridized to the probe are identified by autoradiography or other conventional techniques.

The above procedure may be modified to identify nucleic acids having decreasing levels of homology to the probe sequence. For example, to obtain nucleic acids of decreasing homology to the detectable probe, less stringent conditions may be used. For example, the hybridization temperature may be decreased in increments of 5° C. from 68° C. to 42° C. in a hybridization buffer having a Na+ concentration of approximately 1M. Following hybridization, the filter may be washed with 2×SSC, 0.5% SDS at the temperature of hybridization. These conditions are considered to be "moderate" conditions above 50° C. and "low" conditions below 50° C. A specific example of "moderate" hybridization conditions is when the above hybridization is conducted at 55° C. A specific example of "low stringency" hybridization conditions is when the above hybridization is conducted at 45° C.

Alternatively, the hybridization may be carried out in buffers, such as 6×SSC, containing formamide at a temperature of 42° C. In this case, the concentration of formamide in the hybridization buffer may be reduced in 5% increments from 50% to 0% to identify clones having decreasing levels of homology to the probe. Following hybridization, the filter may be washed with 6×SSC, 0.5% SDS at 50° C. These conditions are considered to be "moderate" conditions above 25% formamide and "low" conditions below 25% formamide. A specific example of "moderate" hybridization conditions is when the above hybridization is conducted at 30% formamide. A specific example of "low stringency" hybridization conditions is when the above hybridization is conducted at 10% formamide.

For example, the preceding methods may be used to isolate nucleic acids having a sequence with at least about 97%, at least 95%, at least 90%, at least 85%, at least 80%, at least 70%, at least 65%, at least 60%, at least 55%, or at least 50% homology to a nucleic acid sequence selected from the group consisting of one of the sequences of Group A nucleic acid sequences, and sequences substantially identical thereto, or fragments comprising at least about 10, 15, 20, 25, 30, 35, 40, 50, 75, 100, 150, 200, 300, 400, or 500 consecutive bases thereof, and the sequences complementary thereto. Homology may be measured using the alignment algorithm. For example, the homologous polynucleotides may have a coding sequence which is a naturally occurring allelic variant of one of the coding sequences described herein. Such allelic variants may have a substitution, deletion or addition of one or more nucleotides when compared to the nucleic acids of Group A nucleic acid sequences or the sequences complementary thereto.

Additionally, the above procedures may be used to isolate nucleic acids which encode polypeptides having at least about 99%, 95%, at least 90%, at least 85%, at least 80%, at least 75%, at least 70%, at least 65%, at least 60%, at least 55%, or at least 50% homology to a polypeptide having the sequence of one of Group B amino acid sequences, and sequences substantially identical thereto, or fragments comprising at least 5, 10, 15, 20, 25, 30, 35, 40, 50, 75, 100, or 150 consecutive amino acids thereof as determined using a sequence alignment algorithm (e.g., such as the FASTA version 3.0t78 algorithm with the default parameters).

Another aspect of the invention is an isolated or purified polypeptide comprising the sequence of one of Group A nucleic acid sequences, and sequences substantially identical thereto, or fragments comprising at least about 5, 10, 15, 20, 25, 30, 35, 40, 50, 75, 100, or 150 consecutive amino acids thereof. As discussed above, such polypeptides may be obtained by inserting a nucleic acid encoding the polypeptide into a vector such that the coding sequence is operably linked to a sequence capable of driving the expression of the encoded polypeptide in a suitable host cell. For example, the expression vector may comprise a promoter, a ribosome binding site for translation initiation and a transcription terminator. The vector may also include appropriate sequences for amplifying expression.

Promoters suitable for expressing the polypeptide or fragment thereof in bacteria include the *E. coli* lac or trp promoters, the lacI promoter, the lacZ promoter, the T3 promoter, the T7 promoter, the gpt promoter, the lambda $P_R$ promoter, the lambda $P_L$ promoter, promoters from operons encoding glycolytic enzymes such as 3-phosphoglycerate kinase (PGK), and the acid phosphatase promoter. Fungal promoters include the V factor promoter. Eukaryotic promoters include the CMV immediate early promoter, the HSV thymidine kinase promoter, heat shock promoters, the early and late SV40 promoter, LTRs from retroviruses, and the mouse metallothionein-I promoter. Other promoters known to control expression of genes in prokaryotic or eukaryotic cells or their viruses may also be used.

Mammalian expression vectors may also comprise an origin of replication, any necessary ribosome binding sites, a polyadenylation site, splice donor and acceptor sites, transcriptional termination sequences, and 5' flanking nontranscribed sequences. In some embodiments, DNA sequences derived from the SV40 splice and polyadenylation sites may be used to provide the required nontranscribed genetic elements.

Vectors for expressing the polypeptide or fragment thereof in eukaryotic cells may also contain enhancers to increase expression levels. Enhancers are cis-acting elements of DNA, usually from about 10 to about 300 bp in length that act on a promoter to increase its transcription. Examples include the SV40 enhancer on the late side of the replication origin bp 100 to 270, the cytomegalovirus early promoter enhancer, the polyoma enhancer on the late side of the replication origin, and the adenovirus enhancers.

In addition, the expression vectors typically contain one or more selectable marker genes to permit selection of host cells containing the vector. Such selectable markers include genes encoding dihydrofolate reductase or genes conferring neomycin resistance for eukaryotic cell culture, genes conferring tetracycline or ampicillin resistance in *E. coli*, and the *S. cerevisiae* TRPI gene.

In some embodiments, the nucleic acid encoding one of the polypeptides of Group B amino acid sequences, and sequences substantially identical thereto, or fragments comprising at least about 5, 10, 15, 20, 25, 30, 35, 40, 50, 75, 100, or 150 consecutive amino acids thereof is assembled in appropriate phase with a leader sequence capable of directing secretion of the translated polypeptide or fragment thereof. Optionally, the nucleic acid can encode a fusion polypeptide in which one of the polypeptides of Group B amino acid sequences, and sequences substantially identical thereto, or fragments comprising at least 5, 10, 15, 20, 25, 30, 35, 40, 50, 75, 100, or 150 consecutive amino acids thereof is fused to heterologous peptides or polypeptides, such as N-terminal identification peptides which impart desired characteristics, such as increased stability or simplified purification.

The appropriate DNA sequence may be inserted into the vector by a variety of procedures. In general, the DNA sequence is ligated to the desired position in the vector following digestion of the insert and the vector with appropriate restriction endonucleases. Alternatively, blunt ends in both the insert and the vector may be ligated. A variety of cloning techniques are disclosed in Ausubel et al. Current Protocols in Molecular Biology, John Wiley 503 Sons, Inc. 1997 and Sambrook et al., Molecular Cloning: A Laboratory Manual 2nd Ed., Cold Spring Harbor Laboratory Press (1989), the entire disclosures of which are incorporated herein by reference. Such procedures and others are deemed to be within the scope of those skilled in the art.

The vector may be, for example, in the form of a plasmid, a viral particle, or a phage. Other vectors include chromosomal, nonchromosomal and synthetic DNA sequences, derivatives of SV40; bacterial plasmids, phage DNA, baculovirus, yeast plasmids, vectors derived from combinations of plasmids and phage DNA, viral DNA such as vaccinia, adenovirus, fowl pox virus, and pseudorabies. A variety of cloning and expression vectors for use with prokaryotic and eukaryotic hosts are described by Sambrook, et al., Molecular Cloning: A Laboratory Manual, 2nd Ed., Cold Spring Harbor, N.Y., (1989), the disclosure of which is hereby incorporated by reference.

Particular bacterial vectors which may be used include the commercially available plasmids comprising genetic elements of the well known cloning vector pBR322 (ATCC 37017), pKK223-3 (Pharmacia Fine Chemicals, Uppsala, Sweden), GEMI (Promega Biotec, Madison, Wis., USA) pQE70, pQE60, pQE-9 (Qiagen), pD10, psiX174 pBluescript II KS, pNH8A, pNH16a, pNH18A, pNH46A (Stratagene), ptrc99a, pKK223-3, pKK233-3, pDR540, pRIT5

(Pharmacia), pKK232-8 and pCM7. Particular eukaryotic vectors include pSV2CAT, pOG44, pXT1, pSG (Stratagene) pSVK3, pBPV, pMSG, and pSVL (Pharmacia). However, any other vector may be used as long as it is replicable and viable in the host cell.

The host cell may be any of the host cells familiar to those skilled in the art, including prokaryotic cells, eukaryotic cells, mammalian cells, insect cells, or plant cells. As representative examples of appropriate hosts, there may be mentioned: bacterial cells, such as *E. coli, Streptomyces, Bacillus subtilis, Salmonella typhimurium* and various species within the genera *Pseudomonas, Streptomyces*, and *Staphylococcus*, fungal cells, such as yeast, insect cells such as *Drosophila* S2 and *Spodoptera* Sf9, animal cells such as CHO, COS or Bowes melanoma, and adenoviruses. The selection of an appropriate host is within the abilities of those skilled in the art.

The vector may be introduced into the host cells using any of a variety of techniques, including transformation, transfection, transduction, viral infection, gene guns, or Ti-mediated gene transfer. Particular methods include calcium phosphate transfection, DEAE-Dextran mediated transfection, lipofection, or electroporation (Davis, L., Dibner, M., Battey, I., Basic Methods in Molecular Biology, (1986)).

Where appropriate, the engineered host cells can be cultured in conventional nutrient media modified as appropriate for activating promoters, selecting transformants or amplifying the genes of the invention. Following transformation of a suitable host strain and growth of the host strain to an appropriate cell density, the selected promoter may be induced by appropriate means (e.g., temperature shift or chemical induction) and the cells may be cultured for an additional period to allow them to produce the desired polypeptide or fragment thereof.

Cells are typically harvested by centrifugation, disrupted by physical or chemical means, and the resulting crude extract is retained for further purification. Microbial cells employed for expression of proteins can be disrupted by any convenient method, including freeze-thaw cycling, sonication, mechanical disruption, or use of cell lysing agents. Such methods are well known to those skilled in the art. The expressed polypeptide or fragment thereof can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the polypeptide. If desired, high performance liquid chromatography (HPLC) can be employed for final purification steps.

Various mammalian cell culture systems can also be employed to express recombinant protein. Examples of mammalian expression systems include the COS-7 lines of monkey kidney fibroblasts (described by Gluzman, Cell, 23:175, 1981), and other cell lines capable of expressing proteins from a compatible vector, such as the C127, 3T3, CHO, HeLa and BHK cell lines.

The constructs in host cells can be used in a conventional manner to produce the gene product encoded by the recombinant sequence. Depending upon the host employed in a recombinant production procedure, the polypeptides produced by host cells containing the vector may be glycosylated or may be non-glycosylated. Polypeptides of the invention may or may not also include an initial methionine amino acid residue.

Alternatively, the polypeptides of Group B amino acid sequences, and sequences substantially identical thereto, or fragments comprising at least 5, 10, 15, 20, 25, 30, 35, 40, 50, 75, 100, or 150 consecutive amino acids thereof can be synthetically produced by conventional peptide synthesizers. In other embodiments, fragments or portions of the polypeptides may be employed for producing the corresponding full-length polypeptide by peptide synthesis; therefore, the fragments may be employed as intermediates for producing the full-length polypeptides.

Cell-free translation systems can also be employed to produce one of the polypeptides of Group B amino acid sequences, and sequences substantially identical thereto, or fragments comprising at least 5, 10, 15, 20, 25, 30, 35, 40, 50, 75, 100, or 150 consecutive amino acids thereof using mRNAs transcribed from a DNA construct comprising a promoter operably linked to a nucleic acid encoding the polypeptide or fragment thereof. In some embodiments, the DNA construct may be linearized prior to conducting an in vitro transcription reaction. The transcribed mRNA is then incubated with an appropriate cell-free translation extract, such as a rabbit reticulocyte extract, to produce the desired polypeptide or fragment thereof.

The invention also relates to variants of the polypeptides of Group B amino acid sequences, and sequences substantially identical thereto, or fragments comprising at least 5, 10, 15, 20, 25, 30, 35, 40, 50, 75, 100, or 150 consecutive amino acids thereof. The term "variant" includes derivatives or analogs of these polypeptides. In particular, the variants may differ in amino acid sequence from the polypeptides of Group B amino acid sequences, and sequences substantially identical thereto, by one or more substitutions, additions, deletions, fusions and truncations, which may be present in any combination.

The variants may be naturally occurring or created in vitro. In particular, such variants may be created using genetic engineering techniques such as site directed mutagenesis, random chemical mutagenesis, Exonuclease III deletion procedures, and standard cloning techniques. Alternatively, such variants, fragments, analogs, or derivatives may be created using chemical synthesis or modification procedures.

Other methods of making variants are also familiar to those skilled in the art. These include procedures in which nucleic acid sequences obtained from natural isolates are modified to generate nucleic acids which encode polypeptides having characteristics which enhance their value in industrial or laboratory applications. In such procedures, a large number of variant sequences having one or more nucleotide differences with respect to the sequence obtained from the natural isolate are generated and characterized. Typically, these nucleotide differences result in amino acid changes with respect to the polypeptides encoded by the nucleic acids from the natural isolates.

For example, variants may be created using error prone PCR. In error prone PCR, PCR is performed under conditions where the copying fidelity of the DNA polymerase is low, such that a high rate of point mutations is obtained along the entire length of the PCR product. Error prone PCR is described in Leung, D. W., et al., Technique, 1:11-15, 1989) and Caldwell, R. C. & Joyce G. F., PCR Methods Applic., 2:28-33, 1992, the disclosure of which is incorporated herein by reference in its entirety. Briefly, in such procedures, nucleic acids to be mutagenized are mixed with PCR primers, reaction buffer, MgCl2, MnCl2, Taq polymerase and an appropriate concentration of dNTPs for achieving a high rate of point mutation along the entire length of the PCR product. For example, the reaction may be performed using 20 fmoles of nucleic acid to be mutagenized, 30 pmole of each PCR primer, a reaction buffer comprising 50 mM KCl, 10 mM Tris HCl (pH 8.3) and 0.01% gelatin, 7 mM MgCl2, 0.5 mM MnCl2, 5 units of Taq polymerase, 0.2 mM dGTP, 0.2 mM dATP, 1 mM dCTP, and 1 mM dTTP. PCR may be performed for 30 cycles of 94° C. for 1 min, 45° C. for 1 min, and 72° C. for 1 min. However, it will be appreciated that these parameters may be varied as appropriate. The mutagenized nucleic acids are cloned into an appropriate vector and the activities of the polypeptides encoded by the mutagenized nucleic acids is evaluated.

Variants may also be created using oligonucleotide directed mutagenesis to generate site-specific mutations in any cloned DNA of interest. Oligonucleotide mutagenesis is described in Reidhaar-Olson, J. F. & Sauer, R. T., et al., Science, 241:53-57, 1988, the disclosure of which is incorporated herein by reference in its entirety. Briefly, in such procedures a plurality of double stranded oligonucleotides bearing one or more mutations to be introduced into the cloned DNA are synthesized and inserted into the cloned DNA to be mutagenized. Clones containing the mutagenized DNA are recovered and the activities of the polypeptides they encode are assessed.

Another method for generating variants is assembly PCR. Assembly PCR involves the assembly of a PCR product from a mixture of small DNA fragments. A large number of different PCR reactions occur in parallel in the same vial, with the products of one reaction priming the products of another reaction. Assembly PCR is described in U.S. Pat. No. 5,965, 408, filed Jul. 9, 1996, entitled, "Method of DNA Reassembly by Interrupting Synthesis", the disclosure of which is incorporated herein by reference in its entirety.

Still another method of generating variants is sexual PCR mutagenesis. In sexual PCR mutagenesis, forced homologous recombination occurs between DNA molecules of different but highly related DNA sequence in vitro, as a result of random fragmentation of the DNA molecule based on sequence homology, followed by fixation of the crossover by primer extension in a PCR reaction. Sexual PCR mutagenesis is described in Stemmer, W. P., PNAS, USA, 91:10747-10751, 1994, the disclosure of which is incorporated herein by reference. Briefly, in such procedures a plurality of nucleic acids to be recombined are digested with DNAse to generate fragments having an average size of 50-200 nucleotides. Fragments of the desired average size are purified and resuspended in a PCR mixture. PCR is conducted under conditions which facilitate recombination between the nucleic acid fragments. For example, PCR may be performed by resuspending the purified fragments at a concentration of 10-30 ng/:1 in a solution of 0.2 mM of each dNTP, 2.2 mM MgCl2, 50 mM KCL, 10 mM Tris HCl, pH 9.0, and 0.1% Triton X-100. 2.5 units of Taq polymerase per 100:1 of reaction mixture is added and PCR is performed using the following regime: 94° C. for 60 seconds, 94° C. for 30 seconds, 50-55° C. for 30 seconds, 72° C. for 30 seconds (30-45 times) and 72° C. for 5 minutes. However, it will be appreciated that these parameters may be varied as appropriate. In some embodiments, oligonucleotides may be included in the PCR reactions. In other embodiments, the Klenow fragment of DNA polymerase I may be used in a first set of PCR reactions and Taq polymerase may be used in a subsequent set of PCR reactions. Recombinant sequences are isolated and the activities of the polypeptides they encode are assessed.

Variants may also be created by in vivo mutagenesis. In some embodiments, random mutations in a sequence of interest are generated by propagating the sequence of interest in a bacterial strain, such as an *E. coli* strain, which carries mutations in one or more of the DNA repair pathways. Such "mutator" strains have a higher random mutation rate than that of a wild-type parent. Propagating the DNA in one of these strains will eventually generate random mutations within the DNA. Mutator strains suitable for use for in vivo mutagenesis are described in PCT Publication No. WO 91/16427, published Oct. 31, 1991, entitled "Methods for Phenotype Creation from Multiple Gene Populations" the disclosure of which is incorporated herein by reference in its entirety.

Variants may also be generated using cassette mutagenesis. In cassette mutagenesis a small region of a double stranded DNA molecule is replaced with a synthetic oligonucleotide "cassette" that differs from the native sequence. The oligonucleotide often contains completely and/or partially randomized native sequence.

Recursive ensemble mutagenesis may also be used to generate variants. Recursive ensemble mutagenesis is an algorithm for protein engineering (protein mutagenesis) developed to produce diverse populations of phenotypically related mutants whose members differ in amino acid sequence. This method uses a feedback mechanism to control successive rounds of combinatorial cassette mutagenesis. Recursive ensemble mutagenesis is described in Arkin, A. P. and Youvan, D. C., PNAS, USA, 89:7811-7815, 1992, the disclosure of which is incorporated herein by reference in its entirety.

In some embodiments, variants are created using exponential ensemble mutagenesis. Exponential ensemble mutagenesis is a process for generating combinatorial libraries with a high percentage of unique and functional mutants, wherein small groups of residues are randomized in parallel to identify, at each altered position, amino acids which lead to functional proteins. Exponential ensemble mutagenesis is described in Delegrave, S. and Youvan, D. C., Biotechnology Research, 11:1548-1552, 1993, the disclosure of which incorporated herein by reference in its entirety. Random and site-directed mutagenesis are described in Arnold, F. H., Current Opinion in Biotechnology, 4:450455, 1993, the disclosure of which is incorporated herein by reference in its entirety.

In some embodiments, the variants are created using shuffling procedures wherein portions of a plurality of nucleic acids which encode distinct polypeptides are fused together to create chimeric nucleic acid sequences which encode chimeric polypeptides as described in U.S. Pat. No. 5,965,408, filed Jul. 9, 1996, entitled, "Method of DNA Reassembly by Interrupting Synthesis", and U.S. Pat. No. 5,939,250, filed May 22, 1996, entitled, "Production of Enzymes Having Desired Activities by Mutagenesis", both of which are incorporated herein by reference.

The variants of the polypeptides of Group B amino acid sequences may be variants in which one or more of the amino acid residues of the polypeptides of the Group B amino acid sequences are substituted with a conserved or non-conserved amino acid residue (preferably a conserved amino acid residue) and such substituted amino acid residue may or may not be one encoded by the genetic code.

Conservative substitutions are those that substitute a given amino acid in a polypeptide by another amino acid of like characteristics. Typically seen as conservative substitutions are the following replacements: replacements of an aliphatic amino acid such as Alanine, Valine, Leucine and Isoleucine with another aliphatic amino acid; replacement of a Serine with a Threonine or vice versa; replacement of an acidic residue such as Aspartic acid and Glutamic acid with another acidic residue; replacement of a residue bearing an amide group, such as Asparagine and Glutamine, with another residue bearing an amide group; exchange of a basic residue such as Lysine and Arginine with another basic residue; and replacement of an aromatic residue such as Phenylalanine, Tyrosine with another aromatic residue.

Other variants are those in which one or more of the amino acid residues of the polypeptides of the Group B amino acid sequences includes a substituent group.

Still other variants are those in which the polypeptide is associated with another compound, such as a compound to increase the half-life of the polypeptide (for example, polyethylene glycol).

Additional variants are those in which additional amino acids are fused to the polypeptide, such as a leader sequence, a secretory sequence, a proprotein sequence or a sequence which facilitates purification, enrichment, or stabilization of the polypeptide.

In some embodiments, the fragments, derivatives and analogs retain the same biological function or activity as the polypeptides of Group B amino acid sequences, and sequences substantially identical thereto. In other embodiments, the fragment, derivative, or analog includes a proprotein, such that the fragment, derivative, or analog can be activated by cleavage of the proprotein portion to produce an active polypeptide.

Another aspect of the invention is polypeptides or fragments thereof which have at least about 50%, at least about 55%, at least about 60%, at least about 65%, at least about 70%, at least about 75%, at least about 80%, at least about 85%, at least about 90%, at least about 95%, or more than about 95% homology to one of the polypeptides of Group B amino acid sequences, and sequences substantially identical thereto, or a fragment comprising at least 5, 10, 15, 20, 25, 30, 35, 40, 50, 75, 100, or 150 consecutive amino acids thereof. Homology may be determined using any of the programs described above which aligns the polypeptides or fragments being compared and determines the extent of amino acid identity or similarity between them. It will be appreciated that amino acid "homology" includes conservative amino acid substitutions such as those described above.

The polypeptides or fragments having homology to one of the polypeptides of Group B amino acid sequences, and sequences substantially identical thereto, or a fragment comprising at least about 5, 10, 15, 20, 25, 30, 35, 40, 50, 75, 100, or 150 consecutive amino acids thereof may be obtained by isolating the nucleic acids encoding them using the techniques described above.

Alternatively, the homologous polypeptides or fragments may be obtained through biochemical enrichment or purification procedures. The sequence of potentially homologous polypeptides or fragments may be determined by proteolytic digestion, gel electrophoresis and/or microsequencing. The sequence of the prospective homologous polypeptide or fragment can be compared to one of the polypeptides of Group B amino acid sequences, and sequences substantially identical thereto, or a fragment comprising at least about 5, 10, 15, 20, 25, 30, 35, 40, 50, 75, 100, or 150 consecutive amino acids thereof using any of the programs described above.

Another aspect of the invention is an assay for identifying fragments or variants of Group B amino acid sequences, and sequences substantially identical thereto, which retain the enzymatic function of the polypeptides of Group B amino acid sequences, and sequences substantially identical thereto. For example the fragments or variants of said polypeptides, may be used to catalyze biochemical reactions, which indicate that the fragment or variant retains the enzymatic activity of the polypeptides in the Group B amino acid sequences.

The assay for determining if fragments of variants retain the enzymatic activity of the polypeptides of Group B amino acid sequences, and sequences substantially identical thereto includes the steps of: contacting the polypeptide fragment or variant with a substrate molecule under conditions which allow the polypeptide fragment or variant to function, and detecting either a decrease in the level of substrate or an increase in the level of the specific reaction product of the reaction between the polypeptide and substrate.

The polypeptides of Group B amino acid sequences, and sequences substantially identical thereto or fragments comprising at least 5, 10, 15, 20, 25, 30, 35, 40, 50, 75, 100, or 150 consecutive amino acids thereof may be used in a variety of applications. For example, the polypeptides or fragments thereof may be used to catalyze biochemical reactions. In accordance with one aspect of the invention, there is provided a process for utilizing the polypeptides of Group B amino acid sequences, and sequences substantially identical thereto or polynucleotides encoding such polypeptides for hydrolyzing glycosidic linkages. In such procedures, a substance containing a glycosidic linkage (e.g., a starch) is contacted with one of the polypeptides of Group B amino acid sequences, or sequences substantially identical thereto under conditions which facilitate the hydrolysis of the glycosidic linkage.

The polypeptides of Group B amino acid sequences, and sequences substantially identical thereto or fragments comprising at least 5, 10, 15, 20, 25, 30, 35, 40, 50, 75, 100, or 150 consecutive amino acids thereof, may also be used in the liquefaction and saccharification of starch. Using the polypeptides or fragments thereof of this invention, liquefaction may be carried out at a lower pH than with previous enzymes. In one embodiment, liquefaction is performed at a pH of 4.5. Additionally, the polypeptides or fragments thereof of this invention are less calcium dependent than enzymes previously used in these processes. In liquefaction amylases are used to hydrolyze starch. In a preferred embodiment, the polypeptides or fragments thereof of this invention are thermostable at 90-95° C.

The polypeptides of Group B amino acid sequences, and sequences substantially identical thereto or fragments comprising at least 5, 10, 15, 20, 25, 30, 35, 40, 50, 75, 100, or 150 consecutive amino acids thereof, may also be used to generate antibodies which bind specifically to the polypeptides or fragments. The resulting antibodies may be used in immunoaffinity chromatography procedures to isolate or purify the polypeptide or to determine whether the polypeptide is present in a biological sample. In such procedures, a protein preparation, such as an extract, or a biological sample is contacted with an antibody capable of specifically binding to one of the polypeptides of Group B amino acid sequences, and sequences substantially identical thereto, or fragments comprising at least 5, 10, 15, 20, 25, 30, 35, 40, 50, 75, 100, or 150 consecutive amino acids thereof.

In immunoaffinity procedures, the antibody is attached to a solid support, such as a bead or other column matrix. The protein preparation is placed in contact with the antibody under conditions in which the antibody specifically binds to one of the polypeptides of Group B amino acid sequences, and sequences substantially identical thereto, or fragment thereof. After a wash to remove non-specifically bound proteins, the specifically bound polypeptides are eluted.

The ability of proteins in a biological sample to bind to the antibody may be determined using any of a variety of procedures familiar to those skilled in the art. For example, binding may be determined by labeling the antibody with a detectable label such as a fluorescent agent, an enzymatic label, or a radioisotope. Alternatively, binding of the antibody to the sample may be detected using a secondary antibody having such a detectable label thereon. Particular assays include ELISA assays, sandwich assays, radioimmunoassays, and Western Blots.

Polyclonal antibodies generated against the polypeptides of Group B amino acid sequences, and sequences substantially identical thereto, or fragments comprising at least 5, 10, 15, 20, 25, 30, 35, 40, 50, 75, 100, or 150 consecutive amino acids thereof can be obtained by direct injection of the polypeptides into an animal or by administering the polypeptides to an animal, for example, a nonhuman. The antibody so obtained will then bind the polypeptide itself. In this manner, even a sequence encoding only a fragment of the polypeptide can be used to generate antibodies which may bind to the whole native polypeptide. Such antibodies can then be used to isolate the polypeptide from cells expressing that polypeptide.

For preparation of monoclonal antibodies, any technique which provides antibodies produced by continuous cell line cultures can be used. Examples include the hybridoma technique (Kohler and Milstein, Nature, 256:495-497, 1975, the disclosure of which is incorporated herein by reference), the trioma technique, the human B-cell hybridoma technique (Kozbor et al., Immunology Today 4:72, 1983, the disclosure of which is incorporated herein by reference), and the EBV-hybridoma technique (Cole, et al., 1985, in Monoclonal Antibodies and Cancer Therapy, Alan R. Liss, Inc., pp. 77-96, the disclosure of which is incorporated herein by reference).

Techniques described for the production of single chain antibodies (U.S. Pat. No. 4,946,778, the disclosure of which is incorporated herein by reference) can be adapted to produce single chain antibodies to the polypeptides of Group B amino acid sequences, and sequences substantially identical thereto, or fragments comprising at least 5, 10, 15, 20, 25, 30, 35, 40, 50, 75, 100, or 150 consecutive amino acids thereof. Alternatively, transgenic mice may be used to express humanized antibodies to these polypeptides or fragments thereof.

Antibodies generated against the polypeptides of Group B amino acid sequences, and sequences substantially identical thereto, or fragments comprising at least 5, 10, 15, 20, 25, 30, 35, 40, 50, 75, 100, or 150 consecutive amino acids thereof may be used in screening for similar polypeptides from other organisms and samples. In such techniques, polypeptides from the organism are contacted with the antibody and those polypeptides which specifically bind the antibody are detected. Any of the procedures described above may be used to detect antibody binding. One such screening assay is described in "Methods for Measuring Cellulase Activities", Methods in Enzymology, Vol 160, pp. 87-116, which is hereby incorporated by reference in its entirety.

As used herein the term "nucleic acid sequence as set forth in SEQ ID Nos.: 1, 3, 5, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299" encompasses the nucleotide sequences of Group A nucleic acid sequences, and sequences substantially identical thereto, as well as sequences homologous to Group A nucleic acid sequences, and fragments thereof and sequences complementary to all of the preceding sequences. The fragments include portions of SEQ ID Nos.: 1, 3, 5, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, and 299, comprising at least 10, 15, 20, 25, 30, 35, 40, 50, 75, 100, 150, 200, 300, 400, or 500 consecutive nucleotides of Group A nucleic acid sequences, and sequences substantially identical thereto. Homologous sequences and fragments of Group A nucleic acid sequences, and sequences substantially identical thereto, refer to a sequence having at least 99%, 98%, 97%, 96%, 95%, 90%, 85%, 80%, 75%, 70%, 65%, 60%, 55% or 50% homology to these sequences. Homology may be determined using any of the computer programs and parameters described herein, including FASTA version 3.0t78 with the default parameters. Homologous sequences also include RNA sequences in which uridines replace the thymines in the nucleic acid sequences as set forth in the Group A nucleic acid sequences. The homologous sequences may be obtained using any of the procedures described herein or may result from the correction of a sequencing error. It will be appreciated that the nucleic acid sequences as set forth in Group A nucleic acid sequences, and sequences substantially identical thereto, can be represented in the traditional single character format (See the inside back cover of Stryer, Lubert. Biochemistry, 3rd Ed., W. H Freeman & Co., New York.) or in any other format which records the identity of the nucleotides in a sequence.

As used herein the term "a polypeptide sequence as set forth in SEQ ID Nos: 2, 4, 6, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298" encompasses the polypeptide sequence of Group B amino acid sequences, and sequences substantially identical thereto, which are encoded by a sequence as set forth in SEQ ID Nos: 2, 4, 6, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, polypeptide sequences homologous to the polypeptides of Group B amino acid sequences, and sequences substantially identical thereto, or fragments of any of the preceding sequences. Homologous polypeptide sequences refer to a polypeptide sequence having at least 99%, 98%, 97%, 96%, 95%, 90%, 85%, 80%, 75%, 70%, 65%, 60%, 55% or 50% homology to one of the polypeptide sequences of the Group B amino acid sequences. Homology may be determined using any of the computer programs and parameters described herein, including FASTA version 3.0t78 with the default parameters or with any modified parameters. The homologous sequences may be obtained using any of the procedures described herein or may result from the correction of a sequencing error. The polypeptide fragments comprise at least 5, 10, 15, 20, 25, 30, 35, 40, 50, 75, 100, or 150 consecutive amino acids of the polypeptides of Group B amino acid sequences, and sequences substantially identical thereto. It will be appreciated that the polypeptide codes as set forth in Group B amino acid sequences, and sequences substantially identical thereto, can be represented in the traditional single character format or three letter format (See the inside back cover of Stryer, Lubert. Biochemistry, 3rd Ed., W. H Freeman & Co., New York.) or in any other format which relates the identity of the polypeptides in a sequence.

It will be appreciated by those skilled in the art that a nucleic acid sequence as set forth in SEQ ID No.s: 1, 3, 5, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299 and a polypeptide sequence as set forth in SEQ ID No.s: 2, 4, 6, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298 can be stored, recorded, and manipulated on any medium which can be read and accessed by a computer. As used herein, the words "recorded" and "stored" refer to a process for storing information on a computer medium. A skilled artisan can readily adopt any of the presently known methods for recording information on a computer readable medium to generate manufactures comprising one or more of the nucleic acid sequences as set forth in Group A nucleic acid sequences, and sequences substantially identical thereto, one or more of the polypeptide sequences as set forth in Group B amino acid sequences, and sequences substantially identical thereto. Another aspect of the invention is a computer readable medium having recorded thereon at least 2, 5, 10, 15, or 20 nucleic acid sequences as set forth in Group A nucleic acid sequences, and sequences substantially identical thereto.

Another aspect of the invention is a computer readable medium having recorded thereon one or more of the nucleic acid sequences as set forth in Group A nucleic acid sequences, and sequences substantially identical thereto. Another aspect of the invention is a computer readable medium having recorded thereon one or more of the polypeptide sequences as set forth in Group B amino acid sequences, and sequences substantially identical thereto. Another aspect of the invention is a computer readable medium having recorded thereon at least 2, 5, 10, 15, or 20 of the sequences as set forth above.

Computer readable media include magnetically readable media, optically readable media, electronically readable media and magnetic/optical media. For example, the computer readable media may be a hard disk, a floppy disk, a magnetic tape, CD-ROM, Digital Versatile Disk (DVD), Random Access Memory (RAM), or Read Only Memory (ROM) as well as other types of other media known to those skilled in the art.

Embodiments of the invention include systems (e.g., internet based systems), particularly computer systems which store and manipulate the sequence information described herein. One example of a computer system 100 is illustrated in block diagram form in FIG. 1. As used herein, "a computer system" refers to the hardware components, software components, and data storage components used to analyze a nucleotide sequence of a nucleic acid sequence as set forth in Group A nucleic acid sequences, and sequences substantially identical thereto, or a polypeptide sequence as set forth in the Group B amino acid sequences. The computer system 100 typically includes a processor for processing, accessing and manipulating the sequence data. The processor 105 can be any well-known type of central processing unit, such as, for example, the Pentium III from Intel Corporation, or similar processor from Sun, Motorola, Compaq, AMD or International Business Machines.

Typically the computer system 100 is a general purpose system that comprises the processor 105 and one or more internal data storage components 110 for storing data, and one or more data retrieving devices for retrieving the data stored on the data storage components. A skilled artisan can readily appreciate that any one of the currently available computer systems are suitable.

In one particular embodiment, the computer system 100 includes a processor 105 connected to a bus which is connected to a main memory 115 (preferably implemented as RAM) and one or more internal data storage devices 110, such as a hard drive and/or other computer readable media having data recorded thereon. In some embodiments, the computer system 100 further includes one or more data retrieving device 118 for reading the data stored on the internal data storage devices 110.

The data retrieving device 118 may represent, for example, a floppy disk drive, a compact disk drive, a magnetic tape drive, or a modem capable of connection to a remote data storage system (e.g., via the internet) etc. In some embodiments, the internal data storage device 110 is a removable computer readable medium such as a floppy disk, a compact disk, a magnetic tape, etc. containing control logic and/or data recorded thereon. The computer system 100 may advantageously include or be programmed by appropriate software for reading the control logic and/or the data from the data storage component once inserted in the data retrieving device.

The computer system 100 includes a display 120 which is used to display output to a computer user. It should also be noted that the computer system 100 can be linked to other computer systems 125a-c in a network or wide area network to provide centralized access to the computer system 100.

Software for accessing and processing the nucleotide sequences of a nucleic acid sequence as set forth in Group A nucleic acid sequences, and sequences substantially identical thereto, or a polypeptide sequence as set forth in Group B amino acid sequences, and sequences substantially identical thereto, (such as search tools, compare tools, and modeling tools etc.) may reside in main memory 115 during execution.

In some embodiments, the computer system 100 may further comprise a sequence comparison algorithm for comparing a nucleic acid sequence as set forth in Group A nucleic acid sequences, and sequences substantially identical thereto, or a polypeptide sequence as set forth in Group B amino acid sequences, and sequences substantially identical thereto, stored on a computer readable medium to a reference nucleotide or polypeptide sequence(s) stored on a computer readable medium. A "sequence comparison algorithm" refers to one or more programs which are implemented (locally or remotely) on the computer system 100 to compare a nucleotide sequence with other nucleotide sequences and/or compounds stored within a data storage means. For example, the sequence comparison algorithm may compare the nucleotide sequences of a nucleic acid sequence as set forth in Group A nucleic acid sequences, and sequences substantially identical thereto, or a polypeptide sequence as set forth in Group B amino acid sequences, and sequences substantially identical thereto, stored on a computer readable medium to reference sequences stored on a computer readable medium to identify homologies or structural motifs. Various sequence comparison programs identified elsewhere in this patent specification are particularly contemplated for use in this aspect of the invention. Protein and/or nucleic acid sequence homologies may be evaluated using any of the variety of sequence comparison algorithms and programs known in the art. Such algorithms and programs include, but are by no means limited to, TBLASTN, BLASTP, FASTA, TFASTA, and CLUSTALW (Pearson and Lipman, Proc. Natl. Acad. Sci. USA 85(8):2444-2448, 1988; Altschul et al., J. Mol. Biol. 215(3): 403-410, 1990; Thompson et al., Nucleic Acids Res. 22(2): 4673-4680, 1994; Higgins et al., Methods Enzymol. 266:383-402, 1996; Altschul et al., J. Mol. Biol. 215(3):403-410, 1990; Altschul et al., Nature Genetics 3:266-272, 1993).

Homology or identity is often measured using sequence analysis software (e.g., Sequence Analysis Software Package of the Genetics Computer Group, University of Wisconsin Biotechnology Center, 1710 University Avenue, Madison, Wis. 53705). Such software matches similar sequences by assigning degrees of homology to various deletions, substitutions and other modifications. The terms "homology" and "identity" in the context of two or more nucleic acids or polypeptide sequences, refer to two or more sequences or subsequences that are the same or have a specified percentage of amino acid residues or nucleotides that are the same when compared and aligned for maximum correspondence over a comparison window or designated region as measured using any number of sequence comparison algorithms or by manual alignment and visual inspection.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters.

A "comparison window", as used herein, includes reference to a segment of any one of the number of contiguous positions selected from the group consisting of from 20 to 600, usually about 50 to about 200, more usually about 100 to about 150 in which a sequence may be compared to a reference sequence of the same number of contiguous positions after the two sequences are optimally aligned. Methods of alignment of sequence for comparison are well-known in the art. Optimal alignment of sequences for comparison can be conducted, e.g., by the local homology algorithm of Smith & Waterman, Adv. Appl. Math. 2:482, 1981, by the homology alignment algorithm of Needleman & Wunsch, J. Mol. Biol 48:443, 1970, by the search for similarity method of person & Lipman, Proc. Nat'l. Acad. Sci. USA 85:2444, 1988, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection. Other algorithms for determining homology or identity include, for example, in addition to a BLAST program (Basic Local Alignment Search Tool at the National Center for Biological Information), ALIGN, AMAS (Analysis of Multiply Aligned Sequences), AMPS (Protein Multiple Sequence Alignment), ASSET (Aligned Segment Statistical Evaluation Tool), BANDS, BESTSCOR, BIOSCAN (Biological Sequence Comparative Analysis Node), BLIMPS (BLocks IMProved Searcher), FASTA, Intervals & Points, BMB, CLUSTAL V, CLUSTAL W, CONSENSUS, LCONSENSUS, WCONSENSUS, Smith-Waterman algorithm, DARWIN, Las Vegas algorithm, FNAT (Forced Nucleotide Alignment Tool), Framealign, Framesearch, DYNAMIC, FILTER, FSAP (Fristensky Sequence Analysis Package), GAP (Global Alignment Program), GENAL, GIBBS, GenQuest, ISSC (Sensitive Sequence Comparison), LALIGN (Local Sequence Alignment), LCP (Local Content Program), MACAW (Multiple Alignment Construction & Analysis Workbench), MAP (Multiple Alignment Program), MBLKP, MBLKN, PIMA (Pattern-Induced Multi-sequence Alignment), SAGA (Sequence Alignment by Genetic Algorithm) and WHAT-IF. Such alignment programs can also be used to screen genome databases to identify polynucleotide sequences having substantially identical sequences. A number of genome databases are available, for example, a substantial portion of the human genome is available as part of the Human Genome Sequencing Project (J. Roach,). At least twenty-one other genomes have already been sequenced, including, for example, *M. genitalium* (Fraser et al., 1995), *M. jannaschii* (Bult et al., 1996), *H. influenzae* (Fleischmann et al., 1995), *E. coli* (Blattner et al., 1997), and yeast (*S. cerevisiae*) (Mewes et al., 1997), and *D. melanogaster* (Adams et al., 2000). Significant progress has also been made in sequencing the genomes of model organism, such as mouse, *C. elegans*, and *Arabadopsis* sp. Several databases containing genomic information annotated with some functional information are maintained by different organization, and are accessible via the internet.

One example of a useful algorithm is BLAST and BLAST 2.0 algorithms, which are described in Altschul et al., Nuc. Acids Res. 25:3389-3402, 1977, and Altschul et al., J. Mol. Biol. 215:403-410, 1990, respectively. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4 and a comparison of both strands. For amino acid sequences, the BLASTP program uses as defaults a wordlength of 3, and expectations (E) of 10, and the BLOSUM62 scoring matrix (see Henikoff & Henikoff, Proc. Natl. Acad. Sci. USA 89:10915, 1989) alignments (B) of 50, expectation (E) of 10, M=5, N=−4, and a comparison of both strands.

The BLAST algorithm also performs a statistical analysis of the similarity between two sequences (see, e.g., Karlin & Altschul, Proc. Natl. Acad. Sci. USA 90:5873, 1993). One measure of similarity provided by BLAST algorithm is the smallest sum probability (P(N)), which provides an indication of the probability by which a match between two nucleotide or amino acid sequences would occur by chance. For example, a nucleic acid is considered similar to a references sequence if the smallest sum probability in a comparison of the test nucleic acid to the reference nucleic acid is less than about 0.2, more preferably less than about 0.01, and most preferably less than about 0.001.

In one embodiment, protein and nucleic acid sequence homologies are evaluated using the Basic Local Alignment Search Tool ("BLAST") In particular, five specific BLAST programs are used to perform the following task:
 (1) BLASTP and BLAST3 compare an amino acid query sequence against a protein sequence database;
 (2) BLASTN compares a nucleotide query sequence against a nucleotide sequence database;
 (3) BLASTX compares the six-frame conceptual translation products of a query nucleotide sequence (both strands) against a protein sequence database;
 (4) TBLASTN compares a query protein sequence against a nucleotide sequence database translated in all six reading frames (both strands); and
 (5) TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which is preferably obtained from a protein or nucleic acid sequence database. High-scoring segment pairs are preferably identified (i.e., aligned) by means of a scoring matrix, many of which are known in the art. Preferably, the scoring matrix used is the BLOSUM62 matrix (Gonnet et al., Science 256:1443-1445, 1992; Henikoff and Henikoff, Proteins 17:49-61, 1993). Less preferably, the PAM or PAM250 matrices may also be used (see, e.g., Schwartz and Dayhoff, eds., 1978, Matrices for Detecting Distance Relationships: Atlas of Protein Sequence and Structure, Washington: National Biomedical Research Foundation). BLAST programs are accessible through the U.S. National Library of Medicine.

The parameters used with the above algorithms may be adapted depending on the sequence length and degree of homology studied. In some embodiments, the parameters may be the default parameters used by the algorithms in the absence of instructions from the user.

Figure 2:
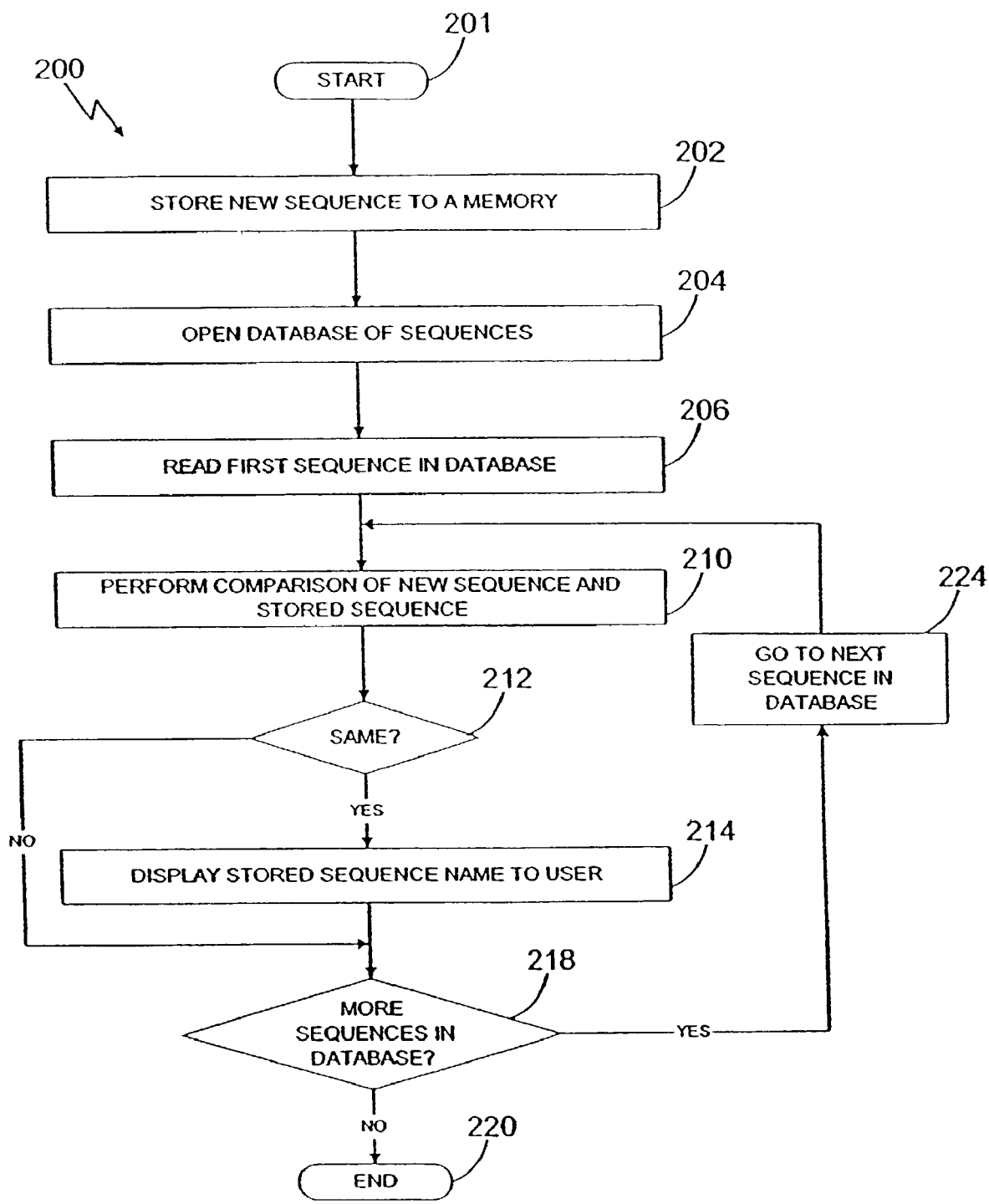
FIG. 2 is a flow diagram illustrating one embodiment of a process for comparing a new nucleotide or protein sequence with a database of sequences in order to determine the homology levels between the new sequence and the sequences in the database.

FIG. 2 is a flow diagram illustrating one embodiment of a process 200 for comparing a new nucleotide or protein sequence with a database of sequences in order to determine the homology levels between the new sequence and the sequences in the database. The database of sequences can be a private database stored within the computer system 100, or a public database such as GENBANK that is available through the Internet.

The process 200 begins at a start state 201 and then moves to a state 202 wherein the new sequence to be compared is stored to a memory in a computer system 100. As discussed above, the memory could be any type of memory, including RAM or an internal storage device.

The process 200 then moves to a state 204 wherein a database of sequences is opened for analysis and comparison. The process 200 then moves to a state 206 wherein the first sequence stored in the database is read into a memory on the computer. A comparison is then performed at a state 210 to determine if the first sequence is the same as the second sequence. It is important to note that this step is not limited to performing an exact comparison between the new sequence and the first sequence in the database. Well-known methods are known to those of skill in the art for comparing two nucleotide or protein sequences, even if they are not identical. For example, gaps can be introduced into one sequence in order to raise the homology level between the two tested sequences. The parameters that control whether gaps or other features are introduced into a sequence during comparison are normally entered by the user of the computer system.

Once a comparison of the two sequences has been performed at the state 210, a determination is made at a decision state 210 whether the two sequences are the same. Of course, the term "same" is not limited to sequences that are absolutely identical. Sequences that are within the homology parameters entered by the user will be marked as "same" in the process 200.

If a determination is made that the two sequences are the same, the process 200 moves to a state 214 wherein the name of the sequence from the database is displayed to the user. This state notifies the user that the sequence with the displayed name fulfills the homology constraints that were entered. Once the name of the stored sequence is displayed to the user, the process 200 moves to a decision state 218 wherein a determination is made whether more sequences exist in the database. If no more sequences exist in the database, then the process 200 terminates at an end state 220. However, if more sequences do exist in the database, then the process 200 moves to a state 224 wherein a pointer is moved to the next sequence in the database so that it can be compared to the new sequence. In this manner, the new sequence is aligned and compared with every sequence in the database.

It should be noted that if a determination had been made at the decision state 212 that the sequences were not homologous, then the process 200 would move immediately to the decision state 218 in order to determine if any other sequences were available in the database for comparison.

Accordingly, one aspect of the invention is a computer system comprising a processor, a data storage device having stored thereon a nucleic acid sequence as set forth in Group A nucleic acid sequences, and sequences substantially identical thereto, or a polypeptide sequence as set forth in Group B amino acid sequences, and sequences substantially identical thereto, a data storage device having retrievably stored thereon reference nucleotide sequences or polypeptide sequences to be compared to a nucleic acid sequence as set forth in Group A nucleic acid sequences, and sequences substantially identical thereto, or a polypeptide sequence as set forth in Group B amino acid sequences, and sequences substantially identical thereto, and a sequence comparer for conducting the comparison. The sequence comparer may indicate a homology level between the sequences compared or identify structural motifs in the above described nucleic acid code of Group A nucleic acid sequences, and sequences substantially identical thereto, or a polypeptide sequence as set forth in Group B amino acid sequences, and sequences substantially identical thereto, or it may identify structural motifs in sequences which are compared to these nucleic acid codes and polypeptide codes. In some embodiments, the data storage device may have stored thereon the sequences of at least 2, 5, 10, 15, 20, 25, 30 or 40 or more of the nucleic acid sequences as set forth in Group A nucleic acid sequences, and sequences substantially identical thereto, or the polypeptide sequences as set forth in Group B amino acid sequences, and sequences substantially identical thereto.

Another aspect of the invention is a method for determining the level of homology between a nucleic acid sequence as set forth in Group A nucleic acid sequences, and sequences substantially identical thereto, or a polypeptide sequence as set forth in Group B amino acid sequences, and sequences substantially identical thereto, and a reference nucleotide sequence. The method including reading the nucleic acid code or the polypeptide code and the reference nucleotide or polypeptide sequence through the use of a computer program which determines homology levels and determining homology between the nucleic acid code or polypeptide code and the reference nucleotide or polypeptide sequence with the computer program. The computer program may be any of a number of computer programs for determining homology levels, including those specifically enumerated herein, (e.g., BLAST2N with the default parameters or with any modified parameters). The method may be implemented using the computer systems described above. The method may also be performed by reading at least 2, 5, 10, 15, 20, 25, 30 or 40 or more of the above described nucleic acid sequences as set forth in the Group A nucleic acid sequences, or the polypeptide sequences as set forth in the Group B amino acid sequences through use of the computer program and determining homology between the nucleic acid codes or polypeptide codes and reference nucleotide sequences or polypeptide sequences.

Figure 3:
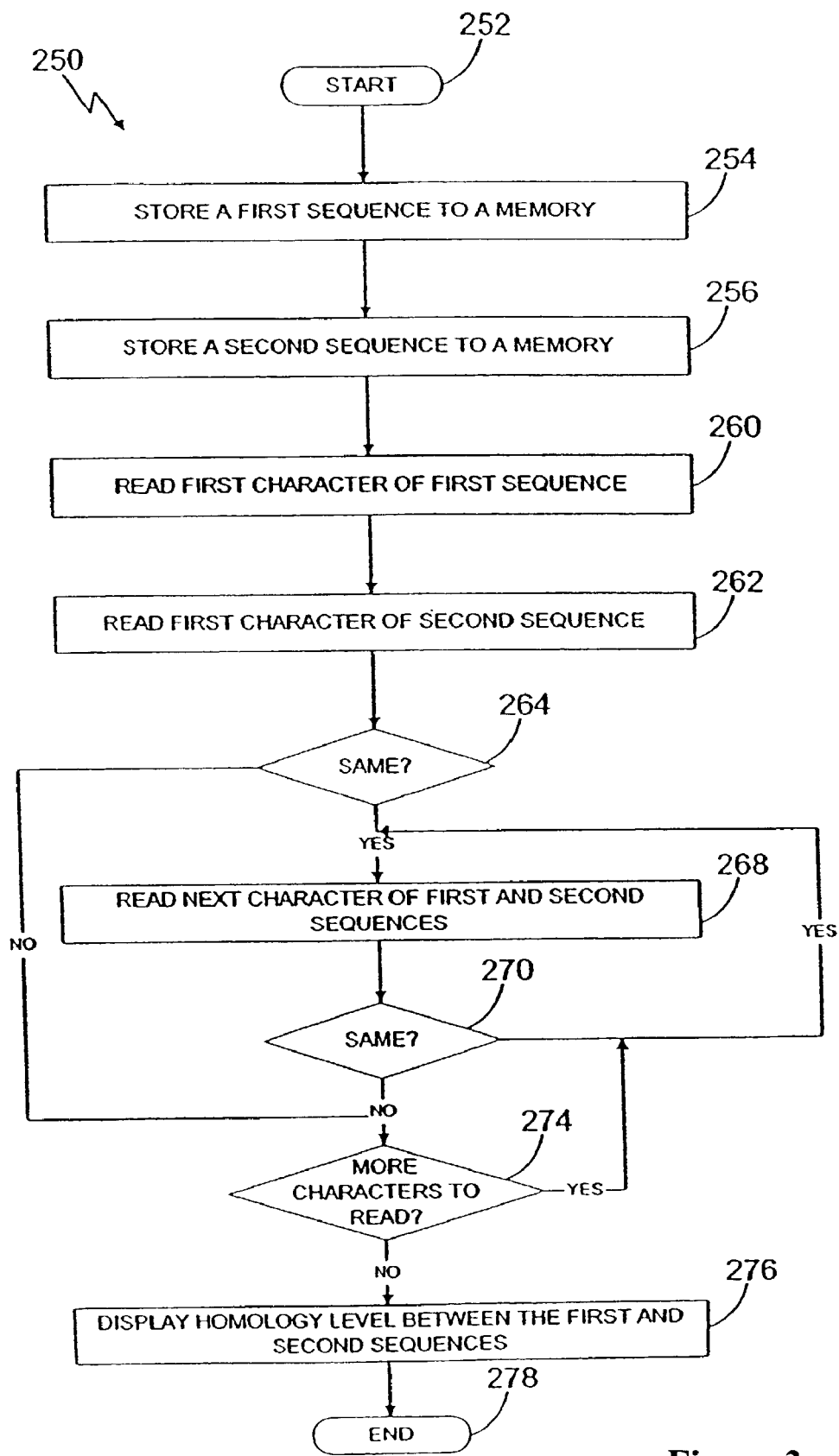
FIG. 3 is a flow diagram illustrating one embodiment of a process in a computer for determining whether two sequences are homologous.
Figure 4:
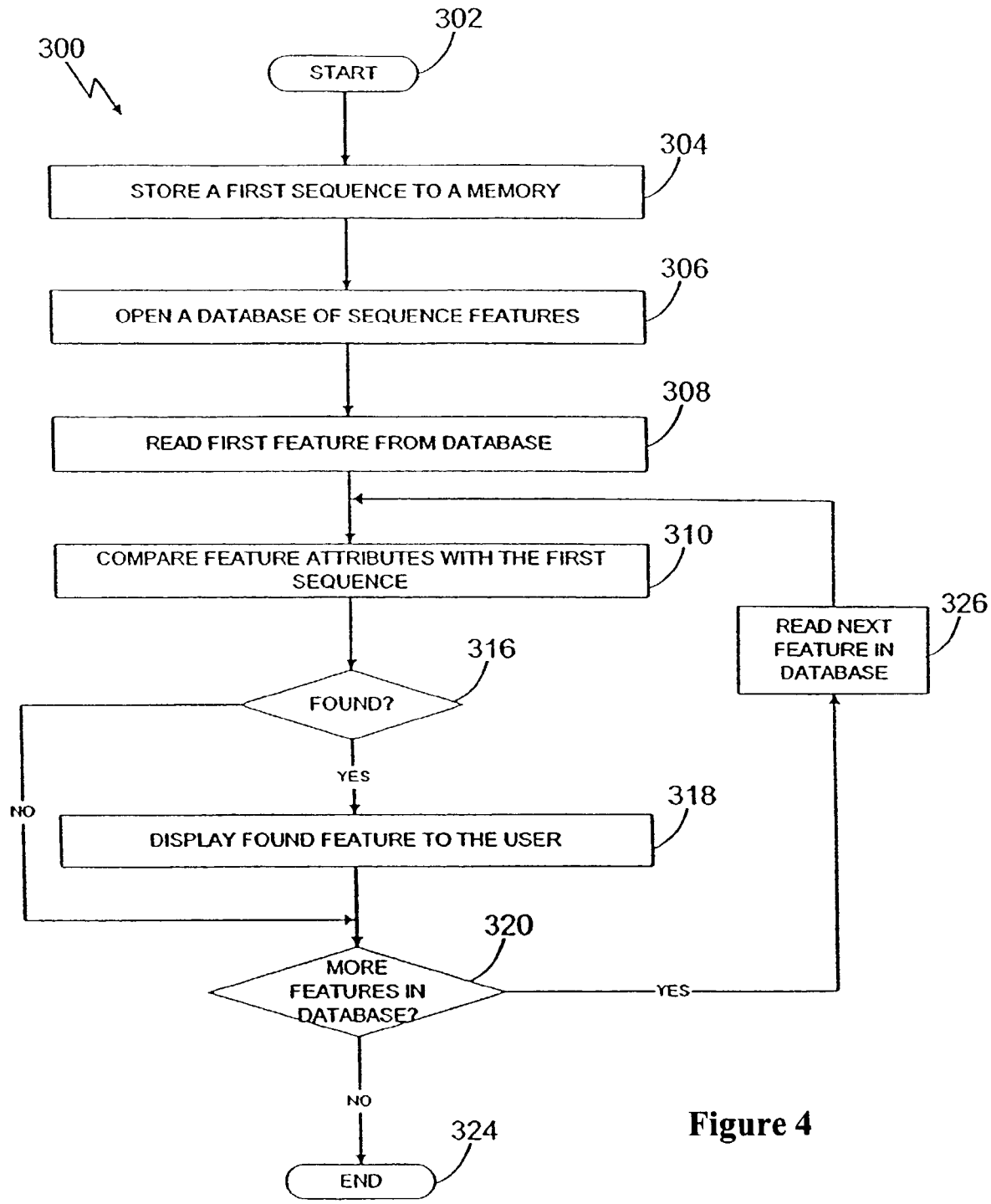
FIG. 4 is a flow diagram illustrating one embodiment of an identifier process 300 for detecting the presence of a feature in a sequence.

FIG. 3 is a flow diagram illustrating one embodiment of a process 250 in a computer for determining whether two sequences are homologous. The process 250 begins at a start state 252 and then moves to a state 254 wherein a first sequence to be compared is stored to a memory. The second sequence to be compared is then stored to a memory at a state 256. The process 250 then moves to a state 260 wherein the first character in the first sequence is read and then to a state 262 wherein the first character of the second sequence is read. It should be understood that if the sequence is a nucleotide sequence, then the character would normally be either A, T, C, G or U. If the sequence is a protein sequence, then it is preferably in the single letter amino acid code so that the first and sequence sequences can be easily compared.

A determination is then made at a decision state 264 whether the two characters are the same. If they are the same, then the process 250 moves to a state 268 wherein the next characters in the first and second sequences are read. A determination is then made whether the next characters are the same. If they are, then the process 250 continues this loop until two characters are not the same. If a determination is made that the next two characters are not the same, the process 250 moves to a decision state 274 to determine whether there are any more characters either sequence to read.

If there are not any more characters to read, then the process 250 moves to a state 276 wherein the level of homology between the first and second sequences is displayed to the user. The level of homology is determined by calculating the proportion of characters between the sequences that were the same out of the total number of sequences in the first sequence. Thus, if every character in a first 100 nucleotide sequence aligned with a every character in a second sequence, the homology level would be 100%.

Alternatively, the computer program may be a computer program which compares the nucleotide sequences of a nucleic acid sequence as set forth in the invention, to one or more reference nucleotide sequences in order to determine whether the nucleic acid code of Group A nucleic acid sequences, and sequences substantially identical thereto, differs from a reference nucleic acid sequence at one or more positions. Optionally such a program records the length and identity of inserted, deleted or substituted nucleotides with respect to the sequence of either the reference polynucleotide or a nucleic acid sequence as set forth in Group A nucleic acid sequences, and sequences substantially identical thereto. In one embodiment, the computer program may be a program which determines whether a nucleic acid sequence as set forth in Group A nucleic acid sequences, and sequences substantially identical thereto, contains a single nucleotide polymorphism (SNP) with respect to a reference nucleotide sequence.

Accordingly, another aspect of the invention is a method for determining whether a nucleic acid sequence as set forth in Group A nucleic acid sequences, and sequences substantially identical thereto, differs at one or more nucleotides from a reference nucleotide sequence comprising the steps of reading the nucleic acid code and the reference nucleotide sequence through use of a computer program which identifies differences between nucleic acid sequences and identifying differences between the nucleic acid code and the reference nucleotide sequence with the computer program. In some embodiments, the computer program is a program which identifies single nucleotide polymorphisms. The method may be implemented by the computer systems described above and the method illustrated in FIG. 3. The method may also be performed by reading at least 2, 5, 10, 15, 20, 25, 30, or 40 or more of the nucleic acid sequences as set forth in Group A nucleic acid sequences, and sequences substantially identical thereto, and the reference nucleotide sequences through the use of the computer program and identifying differences between the nucleic acid codes and the reference nucleotide sequences with the computer program.

In other embodiments the computer based system may further comprise an identifier for identifying features within a nucleic acid sequence as set forth in the Group A nucleic acid sequences or a polypeptide sequence as set forth in Group B amino acid sequences, and sequences substantially identical thereto.

An "identifier" refers to one or more programs which identifies certain features within a nucleic acid sequence as set forth in Group A nucleic acid sequences, and sequences substantially identical thereto, or a polypeptide sequence as set forth in Group B amino acid sequences, and sequences substantially identical thereto. In one embodiment, the identifier may comprise a program which identifies an open reading frame in a nucleic acid sequence as set forth in Group A nucleic acid sequences, and sequences substantially identical thereto.

Figure 5:
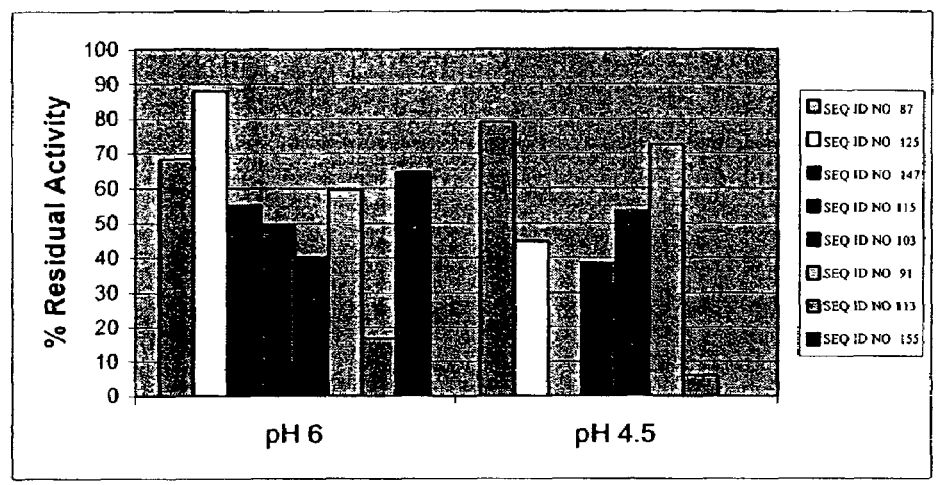
FIG. 5 is a graph showing the Residual activity of various amylases following heating to 90° C. for 10 min in Example 1.

FIG. 5 is a flow diagram illustrating one embodiment of an identifier process 300 for detecting the presence of a feature in a sequence. The process 300 begins at a start state 302 and then moves to a state 304 wherein a first sequence that is to be checked for features is stored to a memory 115 in the computer system 100. The process 300 then moves to a state 306 wherein a database of sequence features is opened. Such a database would include a list of each feature's attributes along with the name of the feature. For example, a feature name could be "Initiation Codon" and the attribute would be "ATG". Another example would be the feature name "TAATAA Box" and the feature attribute would be "TAATAA". An example of such a database is produced by the University of Wisconsin Genetics Computer Group. Alternatively, the features may be structural polypeptide motifs such as alpha helices, beta sheets, or functional polypeptide motifs such as enzymatic active sites, helix-turn-helix motifs or other motifs known to those skilled in the art.

Once the database of features is opened at the state 306, the process 300 moves to a state 308 wherein the first feature is read from the database. A comparison of the attribute of the first feature with the first sequence is then made at a state 310. A determination is then made at a decision state 316 whether the attribute of the feature was found in the first sequence. If the attribute was found, then the process 300 moves to a state 318 wherein the name of the found feature is displayed to the user.

The process 300 then moves to a decision state 320 wherein a determination is made whether move features exist in the database. If no more features do exist, then the process 300 terminates at an end state 324. However, if more features do exist in the database, then the process 300 reads the next sequence feature at a state 326 and loops back to the state 310 wherein the attribute of the next feature is compared against the first sequence.

It should be noted, that if the feature attribute is not found in the first sequence at the decision state 316, the process 300 moves directly to the decision state 320 in order to determine if any more features exist in the database.

Accordingly, another aspect of the invention is a method of identifying a feature within a nucleic acid sequence as set forth in Group A nucleic acid sequences, and sequences substantially identical thereto, or a polypeptide sequence as set forth in Group B amino acid sequences, and sequences substantially identical thereto, comprising reading the nucleic acid code(s) or polypeptide code(s) through the use of a computer program which identifies features therein and identifying features within the nucleic acid code(s) with the computer program. In one embodiment, computer program comprises a computer program which identifies open reading frames. The method may be performed by reading a single sequence or at least 2, 5, 10, 15, 20, 25, 30, or 40 of the nucleic acid sequences as set forth in Group A nucleic acid sequences, and sequences substantially identical thereto, or the polypeptide sequences as set forth in Group B amino acid sequences, and sequences substantially identical thereto, through the use of the computer program and identifying features within the nucleic acid codes or polypeptide codes with the computer program.

A nucleic acid sequence as set forth in Group A nucleic acid sequences, and sequences substantially identical thereto, or a polypeptide sequence as set forth in Group B amino acid sequences, and sequences substantially identical thereto, may be stored and manipulated in a variety of data processor programs in a variety of formats. For example, a nucleic acid sequence as set forth in Group A nucleic acid sequences, and sequences substantially identical thereto, or a polypeptide sequence as set forth in Group B amino acid sequences, and sequences substantially identical thereto, may be stored as text in a word processing file, such as MicrosoftWORD or WORDPERFECT or as an ASCII file in a variety of database programs familiar to those of skill in the art, such as DB2, SYBASE, or ORACLE. In addition, many computer programs and databases may be used as sequence comparison algorithms, identifiers, or sources of reference nucleotide sequences or polypeptide sequences to be compared to a nucleic acid sequence as set forth in Group A nucleic acid sequences, and sequences substantially identical thereto, or a polypeptide sequence as set forth in Group B amino acid sequences, and sequences substantially identical thereto. The following list is intended not to limit the invention but to provide guidance to programs and databases which are useful with the nucleic acid sequences as set forth in Group A nucleic acid sequences, and sequences substantially identical thereto, or the polypeptide sequences as set forth in Group B amino acid sequences, and sequences substantially identical thereto.

The programs and databases which may be used include, but are not limited to: MacPattern (EMBL), DiscoveryBase (Molecular Applications Group), GeneMine (Molecular Applications Group), Look (Molecular Applications Group), MacLook (Molecular Applications Group), BLAST and BLAST2 (NCBI), BLASTN and BLASTX (Altschul et al, J. Mol. Biol. 215: 403, 1990), FASTA (Pearson and Lipman, Proc. Natl. Acad. Sci. USA, 85: 2444, 1988), FASTDB (Brutlag et al. Comp. App. Biosci. 6:237-245, 1990), Catalyst (Molecular Simulations Inc.), Catalyst/SHAPE (Molecular Simulations Inc.), Cerius2.DBAccess (Molecular Simulations Inc.), HypoGen (Molecular Simulations Inc.), Insight II, (Molecular Simulations Inc.), Discover (Molecular Simulations Inc.), CHARMm (Molecular Simulations Inc.), Felix (Molecular Simulations Inc.), DelPhi, (Molecular Simulations Inc.), QuanteMM, (Molecular Simulations Inc.), Homology (Molecular Simulations Inc.), Modeler (Molecular Simulations Inc.), ISIS (Molecular Simulations Inc.), Quanta/Protein Design (Molecular Simulations Inc.), WebLab (Molecular Simulations Inc.), WebLab Diversity Explorer (Molecular Simulations Inc.), Gene Explorer (Molecular Simulations Inc.), SeqFold (Molecular Simulations Inc.), the MDL Available Chemicals Directory database, the MDL Drug Data Report data base, the Comprehensive Medicinal Chemistry database, Derwent's World Drug Index database, the BioByteMasterFile database, the Genbank database, and the Genseqn database. Many other programs and data bases would be apparent to one of skill in the art given the present disclosure.

Motifs which may be detected using the above programs include sequences encoding leucine zippers, helix-turn-helix motifs, glycosylation sites, ubiquitination sites, alpha helices, and beta sheets, signal sequences encoding signal peptides which direct the secretion of the encoded proteins, sequences implicated in transcription regulation such as homeoboxes, acidic stretches, enzymatic active sites, substrate binding sites, and enzymatic cleavage sites.

The present invention exploits the unique catalytic properties of enzymes. Whereas the use of biocatalysts (i.e., purified or crude enzymes, non-living or living cells) in chemical transformations normally requires the identification of a particular biocatalyst that reacts with a specific starting compound, the present invention uses selected biocatalysts and reaction conditions that are specific for functional groups that are present in many starting compounds, such as small molecules. Each biocatalyst is specific for one functional group, or several related functional groups, and can react with many starting compounds containing this functional group.

The biocatalytic reactions produce a population of derivatives from a single starting compound. These derivatives can be subjected to another round of biocatalytic reactions to produce a second population of derivative compounds. Thousands of variations of the original small molecule or compound can be produced with each iteration of biocatalytic derivatization.

Enzymes react at specific sites of a starting compound without affecting the rest of the molecule, a process which is very difficult to achieve using traditional chemical methods. This high degree of biocatalytic specificity provides the means to identify a single active compound within the library. The library is characterized by the series of biocatalytic reactions used to produce it, a so called "biosynthetic history". Screening the library for biological activities and tracing the biosynthetic history identifies the specific reaction sequence producing the active compound. The reaction sequence is repeated and the structure of the synthesized compound determined. This mode of identification, unlike other synthesis and screening approaches, does not require immobilization technologies, and compounds can be synthesized and tested free in solution using virtually any type of screening assay. It is important to note, that the high degree of specificity of enzyme reactions on functional groups allows for the "tracking" of specific enzymatic reactions that make up the biocatalytically produced library.

Many of the procedural steps are performed using robotic automation enabling the execution of many thousands of biocatalytic reactions and screening assays per day as well as ensuring a high level of accuracy and reproducibility. As a result, a library of derivative compounds can be produced in a matter of weeks which would take years to produce using current chemical methods.

In a particular embodiment, the invention provides a method for modifying small molecules, comprising contacting a polypeptide encoded by a polynucleotide described herein or enzymatically active fragments thereof with a small molecule to produce a modified small molecule. A library of modified small molecules is tested to determine if a modified small molecule is present within the library which exhibits a desired activity. A specific biocatalytic reaction which produces the modified small molecule of desired activity is identified by systematically eliminating each of the biocatalytic reactions used to produce a portion of the library, and then testing the small molecules produced in the portion of the library for the presence or absence of the modified small molecule with the desired activity. The specific biocatalytic reactions which produce the modified small molecule of desired activity is optionally repeated. The biocatalytic reactions are conducted with a group of biocatalysts that react with distinct structural moieties found within the structure of a small molecule, each biocatalyst is specific for one structural moiety or a group of related structural moieties; and each biocatalyst reacts with many different small molecules which contain the distinct structural moiety.

In another embodiment, the novel alkaline amylases of the invention were identified by screening for both activity at high pH and identification of amylases with stability in an automatic dish wash (ADW) formulation. Comparisons were made to the amylase derived from *Bacillus lichenformis*. A study of the dependence of hydrolysis on pH showed that the majority of the alkaline amylases of the invention have a pH optima of 7 or less, the exception is clone B with a pH optima of approximately 8. The alkaline amylases of the invention retain activity in ADW formulations, though clone B is sensitive to high temperatures. Preferably, when used in ADW products, the alkaline amylase of the invention will function at a pH 10-11 and at 45-60° C.

The invention will be further described with reference to the following examples; however, it is to be understood that the invention is not limited to such examples.

EXAMPLES

Example 1

Identification and Characterization of Thermostable α-Amylases

The present example shows the identification of novel acid amylases. The screening program was carried out under neutral and low pH conditions. DNA libraries generated from low pH samples were targeted for discovery. This effort afforded the discovery of hundreds of clones having the ability to degrade starch. DNA sequence and bioinformatic analyses classified many of these genes as previously unidentified amylases.

Biochemical Studies

Biochemical analysis of the amylase genomic clones showed that many had pH optima of less than pH 6. Lysates of these genomic clones were tested for thermal tolerance by incubation at 70° C., 80° C., 90° C. or 100° C. for 10 minutes and measurement of residual activity at pH 4.5. Those clones retaining >50% activity after heat treatment at 80° C. were chosen for further analysis. These clones were incubated at 90° C. for 10 minutes at pH 6.0 and 4.5 and tested for residual activity at pH 4.5 (FIG. 1). A number of clones retained >40% of their activity following this treatment. For comparative purposes, residual activity of an evolved amylase, clone c, was equivalent to the best of the second-generation enzymes; the specific activity of clone c was greater.

Thermal activity of the clones with residual activity after heat treatment at 90° C. at pH 4.5 was measured at room temperature, 70° C. and 90° C. at pH 4.5. Table 1 shows that the hydrolysis rates of SEQ ID NO.: 87 (*B. stearothermophilus* amylase) and SEQ ID NO. 113 (*B. licheniformis* amylase) decrease at higher temperatures, whereas the rate for SEQ ID NO.: 125 continues to increase as the temperature is raised to 70° C. and only reduces by around 50% at 90° C.

Candidate Evaluation

Based on residual activity at pH 4.5 after a 90° C. heat treatment, specific activity and rate of starch hydrolysis at 90° C. when compared with *B. licheniformis* amylase, SEQ ID NO.:125 is compared with the evolved amylase clone c in a starch liquefaction assay.

TABLE 1

Rates of dye labeled starch hydrolysis (relative fluorescence units/s) of three genomic clones at pH 4.5 and 3 different temperatures.

|  | Room temperature | 70° C. | 90° |
|---|---|---|---|
| SEQ ID NO.: 87[1] | 1.25 | 1.43 | 0.33 |
| SEQ ID NO.: 113[2] | 3.3 | 1.9 | 0.39 |
| SEQ ID NO.: 125 | 1.9 | 47 | 19 |

[1]*B. stearothermophilus* amylase,
[2]*B. licheniformis* amylase

Example 2

Thermostable Amylases Active at Alkaline pH

The initial focus of this example was the evaluation of an existing panel of amylases in an commercial automatic dish wash (ADW) formulation. This effort identified two candidates: one with activity at high pH (SEQ ID NO.:115) and another with stability in the ADW formulation (SEQ ID NO.: 207). Studies also included the identification of high pH amylases. This effort afforded the discovery of hundreds of clones having the ability to degrade starch. DNA sequence and bioinformatics analyses classified many of these genes as previously unidentified amylases. The remaining open reading frames were neopullulanases, amylopullulanases and amylomaltases. Extensive biochemical and applications studies showed that 3 candidates: clone B, SEQ ID NO.:147 and SEQ ID NO.:139) have high specific activity at pH10, but unfortunately lack stability in the ADW formulation. In summary, a panel of novel amylases each having desirable phenotypes for the ADW application has been identified.

Biochemical Studies

Biochemical analysis of the amylase genomic clones showed that many of them hydrolyzed starch at pH 10 and 50° C. To produce sufficient quantities of enzyme for further biochemical and applications testing, the amylase open reading frames of the 40 most active genomic clones were subcloned into expression vectors. This effort included making 2 constructs for those clones containing a putative signal sequence and establishing the growth and induction conditions for each subclone (plus and minus the amylase signal peptide).

Soluble, active protein was successfully purified to homogeneity from 34 subclones and specific activity (units/mg, where 1 unit=μmol reducing sugars/min) was measured at pH 8 and pH 10 (40° C. and 50° C.) using 2% starch in buffer. The amylase from *Bacillus licheniformis* (SEQ ID NO.:113) was chosen as the benchmark for these studies. Specific activity was determined by removing samples at various time points during a 30 minute reaction and analyzing for reducing sugars. The initial rate was determined by fitting the progress curves to a linear equation. A comparison of the top candidates is shown in Table 2.

A study to determine the dependence of hydrolysis rate on pH showed that only clone B is an "alkaline amylase" with a pH optimum of approximately 8; all others had pH optima of 7 or less. Nevertheless, it is clear that the panel of hits included several lead amylases with appreciable activity at pH 10 and 50° C.

TABLE 2

Specific activities (U/mg pure enzyme) of amylases

| Enzyme | Specific activity pH 8, 40° C. | Specific activity pH 10, 50° C. |
|---|---|---|
| Clone B | 682 | 20 |
| SEQ ID NO.: 139 | 430 | 33 |
| SEQ ID NO.: 127 | 250 | 47 |
| SEQ ID NO.: 137 | 230 | 3 |
| SEQ ID NO.: 113 (*B. licheniformis*) | 228 | 27 |
| SEQ ID NO.: 205 | 163 | 4 |
| Remainder | <40 | |

Stability

Stability in the presence of the ADW formulation was measured for each of the 3 top candidates identified via biochemical analysis. The benchmark for these studies was a commercial enzyme in the formulation matrix. FIG. 13 illustrates the residual activity (measured at pH 8 and 50° C.) after a 30 minute incubation at 50° C. in the presence of various components of the ADW formulation; pH 8, pH 10.8, ADW solution (with bleach) and ADW solution (without bleach). The measured activity after the incubation is expressed as a percentage of the original activity. The data show that clone B was very sensitive to high temperature, whereas the other amylases were less affected. When the enzymes were incubated at high pH and temperature, the commercial enzyme SEQ ID NO.: 139 became less stable; however, SEQ ID NO.: 127 retained full activity. The apparently anomalous behavior of SEQ ID NO.: 127 after pH 10 incubation vs pH 8 was observed in repeated trials.

When amylase activity on dye-labeled starch is measured in the ADW matrix at 50° C., the commercial amylase exhibits roughly 5% of its activity at pH 8. In the same assay, clone B, SEQ ID NO.: 139 and SEQ ID NO.: 127 exhibit <2% of their original activity measured at pH 8.

Wash Tests

Figure 6:
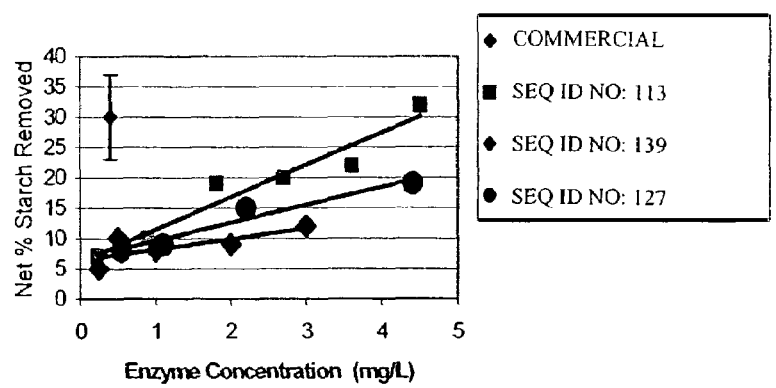
FIG. 6 is a graph showing the net percent starch removed versus enzyme concentration in ADW wash test with bleach and chelators.

Wash tests using starch coated slides were carried out to gauge the performance of each of the purified enzymes as compared to the commercial amylase. The spaghetti starch coated slides were prepared according to protocol. Two pre-weighed starch coated slides were placed back to back in a 50 mL conical tube and 25 mL of ADW solution, +/−enzyme were added per tube. The tubes were incubated for 20 minutes at 50° C. with gentle rotation on a vertical carousel. Following the incubation period, the slides were immediately rinsed in water and oven dried overnight. All trials were run in duplicate and the commercial enzyme was run as a positive control. The results (FIG. 6) of these experiments are expressed as net % starch removed, e.g. % of starch removed in ADW with enzyme, minus the % of starch removed in ADW alone.

Example 3

Gene Optimization

The properties of enzymes may be improved by various evolution strategies, including GeneSiteSaturationMutagenesis (GSSM™) and GeneReassembly™. (Diversa Corporation, San Diego, Calif.). Such techniques will be applied to the discovered amylase genes in order to generate pools of variants that can be screened for improved performance.

Parental molecules for evolution will be one or all of the following: SEQ ID NO.: 113, SEQ ID NO.: 139, SEQ ID NO.:115 and SEQ ID NO.: 127 (a truncated form of SEQ ID NO.: 127).

Figure 7:
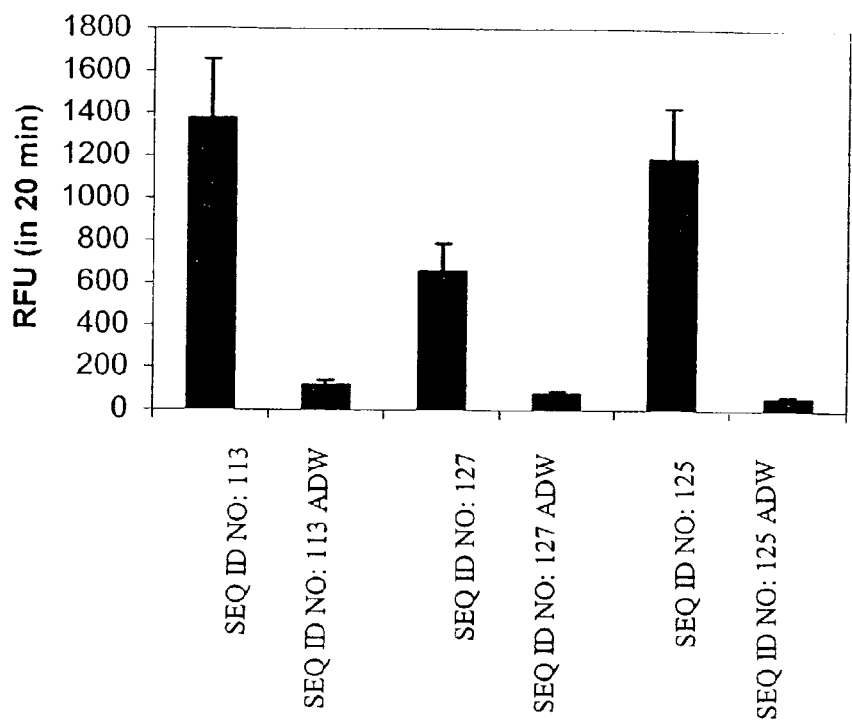
FIG. 7 is a graph showing the activity of parental amylases at pH 8, 40° C. in ADW formulation at 55° C.
Figure 8:
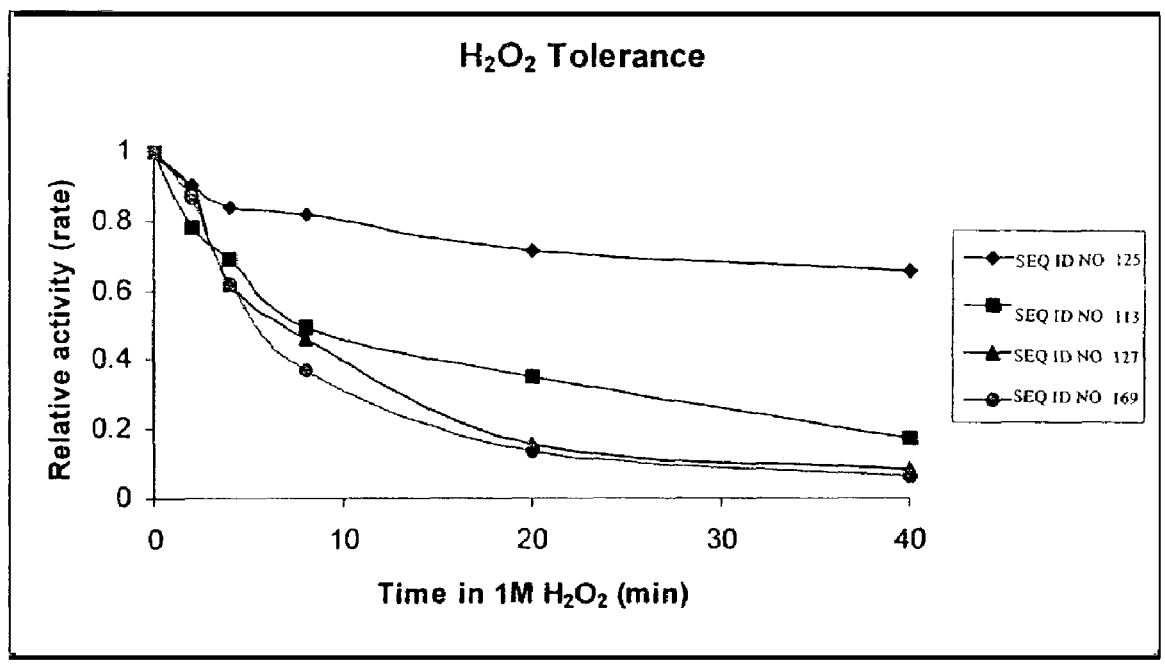
FIG. 8 is a graph of data regarding the $H_2O_2$ tolerance of the novel enzymes in Example 4.
Figure 9A:
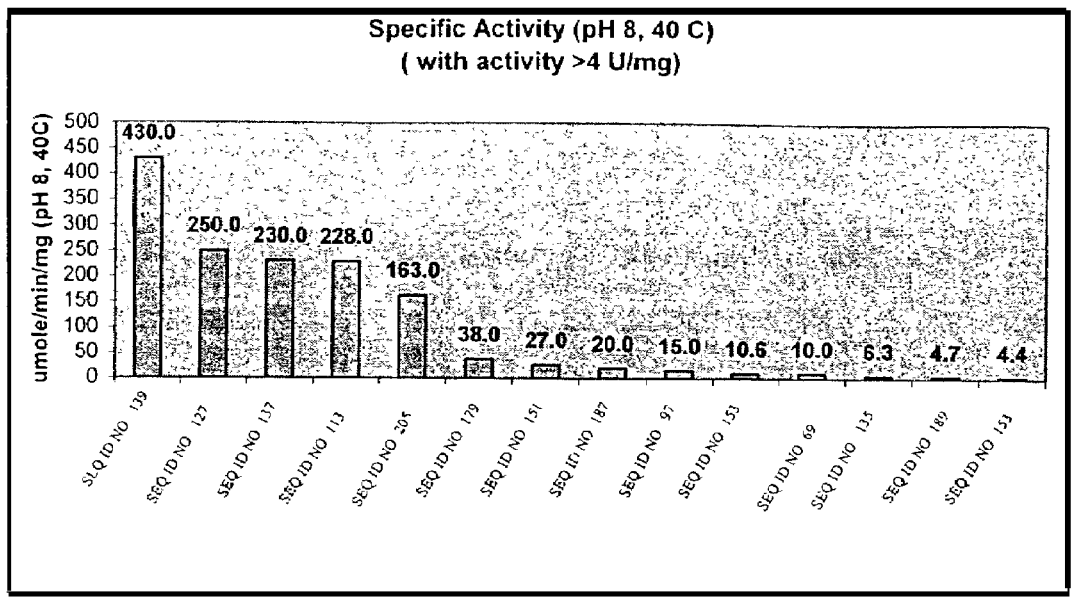
FIG. 9a shows the data at pH 8 and 40° C.
Figure 9B:
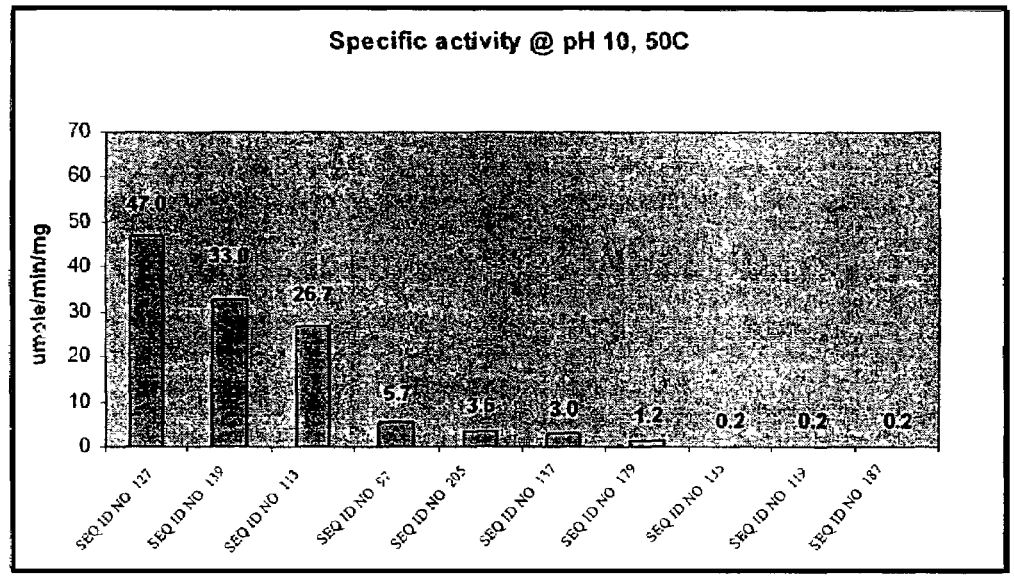
FIG. 9b shows the data at pH 10 and 50° C.
Figure 15:
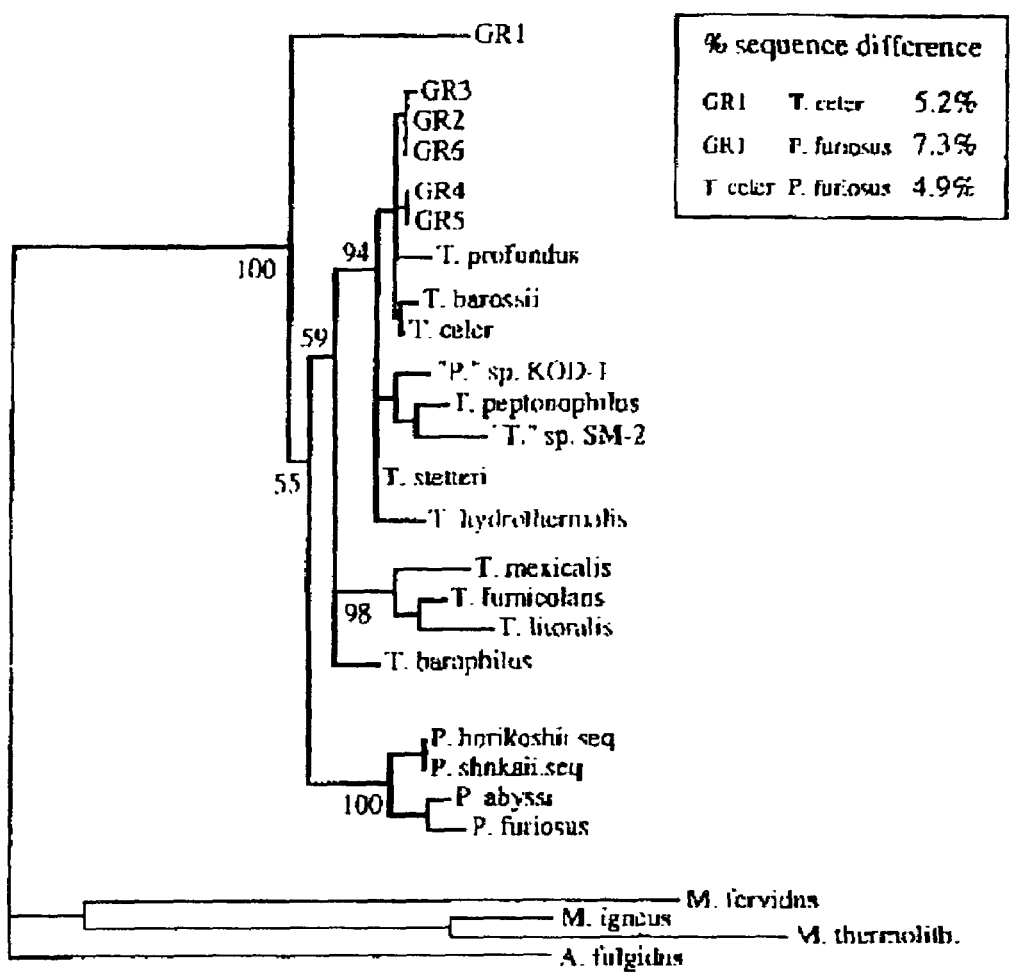
FIG. 15 is a neighbor-joining tree for *Thermococcales*.

A high throughput screen has been developed to assess enzyme performance in the presence of ADW performance. Development of a HTS is of paramount importance in any evolution program The HTS is automated and has showed consistent results for the parental amylases (FIG. 7). Parental amylases have measurable activity in the ADW formulation, however highly reduced relative to pH 8 activity.

Example 4

Characterization of α-Amylases having Activity at Alkaline pH

Amylases of the invention having activity at alkaline pH were characterized further. Kinetics on 2% starch at pH 8 and 10 (40° C. and 50° C.) have been performed.

TABLE 4

| Clones, specific activities | pH 8, 40° C. | pH 10, 50° C. |
|---|---|---|
| SEQ ID NO.: 113 (*B. lichenoformis*) | 228 units/mg | 27 units/mg |
| Clone B | 682 units/mg | 31 units/mg |
| SEQ ID NO.: 139 | 430 units/mg | 33 units/mg |
| SEQ ID NO.: 127 | 540 units/mg | 50 units/mg |
| control 0GL5 (*E. coli*) | 1.8 units/mg | 0 units/mg |

1 unit of activity is defined as release of 1 μmol reducing sugars per minute.

Example 5

Amylase Activity Assay: BCA Reducing Ends Assay

Amylase activity of clones of interest was determined using the following methodology.
1. Prepare 2 substrate solutions, as follows:
   a) 2% soluble starch (potato) pH 8 solution by dissolving 2 gm potato starch in 100 ml 100 mM sodium phosphate pH 8).
   b) 2% soluble starch (potato) pH 10 solution by dissolving 2 gm potato starch in 100 ml 100 mM sodium carbonate.
   Heat both solutions in a boiling water bath, while mixing, for 3040 minutes until starch dissolves.
2. Prepare Solution A from 64 mg/ml sodium carbonate monohydrate, 24 mg/ml sodium bicarbonate and 1.95 mg/ml BCA (4,4'-dicarboxy-2,2'- biquinoline disodium salt (Sigma Chemical cat # D-8284). Added above to dH2O.
3. Prepare solution B by combining 1.24 mg/ml cupric sulfate pentahydrate and 1.26 mg/ml L-serine. Add mixture to to dH2O.
4. Prepare a working reagent of a 1:1 ration of solutions A and B.
5. Prepare a Maltose standard solution of 10 mM Maltose in dH2O, where the 10 mM maltose is combined in 2% soluble starch at desired pH to a final concentration of 0, 100, 200, 300, 400, 600 μM. The standard curve will be generated for each set of time-points. Since the curve is determined by adding 10 ul of the standards to the working reagent it works out to 0, 1, 2, 3, 4, 6 nmole maltose.
6. Aliquot 1 ml of substrate solution into microcentrifuge tubes, equilibrate to desired temperature (5 min) in heat block or heated water bath. Add 50 ul of enzyme solution to the inside of the tube lid.
7. While solution is equilibrating mix 5 ml of both solution A & B. Aliquot 100 ul to 96 well PCR plate. Set plate on ice.
8. After 5 minute temperature equilibration, close lid on tubes, invert and vortex 3 times. Immediately aliquot 10 ul into plate as t=0 (zero time point). Leave enzyme mixture in heat block and aliquot 10 ul at each desired time point (e.g. 0, 5, 10, 15, 20, 30 minutes).
9. Ensure that 12 wells are left empty (only working reagent aliquotted) for the addition of 10 ul of standards, for the standard curve.
10. When all time points are collected and standards are added, cover plate and heated to 80° C. for 35 min. Cool plate on ice for 10 min. Add 100 ul H2O to all wells. Mix and aliquot 100 ul into flat bottomed 96-well plate and read absorbance at 560 nm.
11. Zero each sample's time points against its own t=0 (subtract the average t=-0 A560 value from other average A560 values). Convert the $A560_{(experimental)}$ to umole (Divide $A560_{(experimental)}$ by the slope of the standard curve (A560/umole). Generate a slope of the time points and the umole (in umole/min), multiply by 100 (as the umole value only accounts for the 10 ul used in the assay, not the amount made in the 1 ml rxn). To get the specific activity divide the slope (in umole/min) by the mg of protein. All points should be done at a minimum in duplicate with three being best. An example standard curve is set forth in FIG. 11.

TABLE 5

Sample data:

| Clone | Dilution | Minutes | A560-1 | A560-2 | Avg A 560 | Zeroed A 560 | (A560exp/std slope) umole |
|---|---|---|---|---|---|---|---|
| ENZ | 50 | 0 | 0.1711 | 0.1736 | 0.17235 | 0 | 0.0000 |
| | | 5 | 0.2104 | 0.2165 | 0.21345 | 0.0411 | 0.0005 |
| | | 10 | 0.2492 | 0.2481 | 0.24865 | 0.0763 | 0.0009 |
| | | 15 | 0.2984 | 0.2882 | 0.2933 | 0.12095 | 0.0014 |
| | | 20 | 0.3355 | 0.3409 | 0.3382 | 0.16585 | 0.0020 |
| | | 30 | 0.3942 | 0.3805 | 0.38735 | 0.215 | 0.0026 |
| | | 40 | 0.4501 | 0.4412 | 0.44565 | 0.2733 | 0.0033 |

Activity = 0.008646 umole/min
Divide protein concentration (mg/ml) by any dilution to get mg used in assay.
Divide the above slope by mg used in assay to get specific activity
Specific Activity = 24.93 umole/min/mg (See for example, Dominic W. S. Wong, Sarah B. Batt, and George H. Robertson (2000). Microassay for rapid screening of alpha-amylase activity. J. Agric.Foood Chem. 48, 4540-4543 and Jeffery D. Fox and John F. Robyt, (991). Minituratization of three carbohydrate analyses using a micro sample plate reader. Anal. Biochem. 195, 93-96, herein incorporated by reference).

Example 6

Screening for α-Amylase Activity

Amylase activity of clones can be assessed by a number of methods known in the art. The following is the general methodology that was used in the present invention. The number of plaques screened, per plate, should be approximately 10,000 pfu's. For each DNA library: at least 50,000 plaques per isolated library and 200,000 plaques per non-isolated library should be screened depending upon the pfu titer for the λ Zap Express amplified lysate.

Titer Determination of Lambda Library

1) µL of Lambda Zap Express amplified library stock added to 600 µL E. coli MRF' cells ($OD_{600}$=1.0). To dilute MRF' stock, 10 mM $MgSO_4$ is used.
2) Incubate at 37° C. for 15 minutes.
3) Transfer suspension to 5-6 mL of NZY top agar at 50° C. and gently mix.
4) Immediately pour agar solution onto large (150 mm) NZY media plate.
5) Allow top agar to solidify completely (approximately 30 minutes), then invert plate.
6) Incubate the plate at 39° C. for 8-12 hours.
7) Number of plaques is approximated. Phage titer determined to give 10,000 pfu/plate. Dilute an aliquot of Library phage with SM buffer if needed.

Substrate Screening

1) Lambda Zap Express (50,000 pfu) from amplified library added to 600 µL of E. coli MRF' cells (OD600=1.0). For non-environment libraries, prepare 4 tubes (50,000 pfu per tube).
2) Incubate at 37° C. for 15 minutes.
3) While phage/cell suspension are incubating, 1.0 mL of red starch substrate (1.2% w/v) is added to 6.0 mL NZY top agar at 50° C. and mixed thoroughly. Keep solution at 50° C. until needed.
4) Transfer ⅕ (10,000 pfu) of the cell suspension to substrate/top agar solution and gently mixed.
5) Solution is immediately poured onto large (150 mm) NZY media plate.
6) Allow top agar to solidify completely (approximately 30 minutes), then invert plate.
7) Repeat procedures 4-6 4 times for the rest of the cell suspension (⅕ of the suspension each time).
8) Incubate plates at 39° C. for 8-12 hours.
9) Plate observed for clearing zones (halos) around plaques.
10) Plaques with halos are cored out of agar and transferred to a sterile micro tube. A large bore 200 µL pipette tip works well to remove (core) the agar plug containing the desired plaque.
11) Phages are re-suspended in 500 µL SM buffer. 20 µL Chloroform is added to inhibit any further cell growth.
12) Pure phage suspension is incubated at room temperature for 4 hours or overnight before next step.

Isolation of Pure Clones 1) 10 µL of re-suspended phage suspension is added to 500 µL of E. coli MRF' cells (OD600=1.0).
2) Incubate at 37° C. for 15 minutes.
3) While phage/cell suspension is incubating, 1 mL of red starch substrate (1.2% w/v) is added to 6.0 mL NZY top agar at 50° C. and mixed thoroughly. Keep solution at 50° C. until needed.
4) Cell suspension is transferred to substrate/top agar solution and gently mixed.
5) Solution is immediately poured onto large (150 mm) NZY media plate.
6) Allow top agar to solidify completely (approximately 30 minutes), then invert plate.
7) Plate incubated at 39° C. for 8-12 hours.
8) Plate observed for a clearing zone (halo) around a single plaque (pure clone). If a single plaque cannot be isolated, adjust titer and re-plate phage suspension.
9) Single plaque with halo is cored out of agar and transferred to a sterile micro tube. A large bore 200 µL pipette tip works well to remove (core) the agar plug containing the desired plaque. To amplify the titer, core 5 single active plaques into a micro tube.
10) Phages are re-suspended in 500 µL SM buffer. 20 µL Chloroform is added to inhibit any further cell growth.
11) Pure phage suspension is incubated at room temperature for 4 hours or overnight before next step. The pure phage suspension is stored at −80° C. by adding DMSO into the phage suspension (7% v/v).

Excision of Pure Clone 1) 100 µL of pure phage suspension is added to 200 µL E. coli MRF' cells (OD600=1.0). To this, 1.0 µL of ExAssist helper phage (>1×106 pfu/mL; Stratagene) is added. Use 2059 Falcon tube for excision.
2) Suspension is incubated at 37° C. for 15 minutes.
3) 3.0 mL of 2×YT media is added to cell suspension.
4) Incubate at 30° C. for at least 6 hours or overnight while shaking.
5) Tube transferred to 70° C. for 20 minutes. The phagemid suspension can be stored at 4° C. for 1 to 2 months.
6) 100 µL of phagemid suspension transferred to a micro tube containing 200 L of E. coli Exp 505 cells (OD600=1.0).
7) Suspension incubated at 37° C. for 15 minutes.
8) 300 µL of SOB is added to the suspension.
9) Suspension is incubated at 37° C. for 30 to 45 minutes.
10) 100 µL of suspension is transferred to a small (90 mm) LB media plate containing Kanamycin (LB media with Kanamycin 50 µg/mL) for Zap Express DNA libraries or Ampicillin (LB media with Kanamycin 100 µg/mL) for Zap II DNA libraries.
11) The rest of suspension is transferred to another small LB media plate.
12) Use sterile glass beads to evenly distribute suspension on the plate.
13) Plates are incubated at 30° C. for 12 to 24 hours.
14) Plate observed for colonies.
15) Inoculate single colony into LB liquid media containing suitable antibiotic and incubate at 30° C. for 12 to 24 hours.
16) Glycerol stock can be prepared by adding 80% glycerol into liquid culture (15% v/v) and stored at −80° C.

Activity Verification 1) 50 µL of liquid culture is transferred to a micro tube. Add 500 µL of 8% pH 7 Amylopectin Azure into the same tube. Prepare 2 tubes for each clone.
2) Activity is tested at 50° C. for 3 hours and overnight. Use pH 7 buffer as control.
3) Cool the test specimen at ice-water bath for 5 minutes.
4) Add 750 µL of Ethaqnol and mixed thoroughly.
5) Centrifuge at 13000 rpm (16000 g's) for 5 minutes.
6) Measure OD of the supernatant at 595 nm.

RFLP Analysis 1) 1.0 mL of liquid culture is transferred to a sterile micro tube.
2) Centrifuge at 13200 rpm (16000 g's) for 1 minute.
3) Discard the supernatant. Add another 1.0 mL of liquid culture into the same sterile micro tube.
4) Centrifuge at 13200 rpm (16000 g's) for 1 minute.
5) Discard the supernatant.
6) Follow QIAprep spin mini kit protocol for plasmid isolation.
7) Check DNA concentration using BioPhotometer.
8) Use Sac I and Kpn I for first double digestion. Incubate at 37° C. for 1 hour.

9) Use Pst I and Xho I for second double digestion. Incubate at 37° C. for 1 hour.
10) Add Loading dye into the digested sample.
11) Run the digested sample on a 1.0% agarose gel for 1-1.5 hours at 120 volts.
12) View gel with gel imager. All clones with a different digest pattern will be sent for sequence analysis.

Example 7

Assay for Amylases

Preparation of Host Cultures
1. Start an overnight culture of XL1-Blue MRF' host cells. Use a single colony from a streak plate to inoculate 10 mL LB supplemented with 20 ug/mL tetracycline. Grow overnight culture shaking at 37° C. for at least 16 hours.
2. Using aseptic technique, inoculate a fresh 100 mL of $LB_{Tet}$ day culture with XL1-Blue MRF' host from the overnight $LB_{Tet}$ culture.
3. Grow in a 37° C. shaker until the OD reaches 0.75-1.0.
4. Pellet host cells at 1000 x g for 10 minutes and gently resuspend in 10 mM $MgSO_4$ at OD5.
5. Dilute a small amount of host cells to OD1 for use in titering and pintooling.
6. Host preparations can be used for up to 1 week when stored on ice or at 4° C.

Comments

To shorten growth time for the day culture, use ½× the usual Tet concentration in LB (½×=10 ug/mL), or omit the antibiotic altogether.

Do not use NZY when selecting with Tetracycline. The high $Mg^{++}$ concentration in NZY medium renders Tet inactive.

Titering Lambda Libraries
7. Place three sterile microfuge tubes in a rack.
8. Aliquot 995 uL prepared host cells in one tube and 45 uL prepared OD1 host cells into each of the two remaining tubes.
9. Add 5 uL of lambda library to the tube containing 995 uL host cells and mix by vortexing. This results in a dilution factor of 200.
10. Prepare ½,000 and ½0,000 dilutions by consecutively adding 5 uL of previous dilution to the remaining two tubes containing 45 uL prepared host cells. Mix by vortexing after each dilution was made.
11. Allow phage to adsorb to host by incubating at 37° C. for 15 minutes.
12. Meanwhile, pipet 100 uL of prepared OD1 host cells to each of three Falcon 2059 tubes.
13. Add 5 uL of each dilution to a separate 2059 tube containing host cells.
14. Plate each by adding 3 mL top agar to each tube and quickly pour over 90 mm NZY plates. Ensure a smooth, even distribution before the top agar hardens.
15. Invert plates and incubate at 37° C. overnight.
16. Count plaques and calculate titer of the library stock (in plaque forming units (pfu) per uL).

Lambda Microtiter Screening For Amylases

Preparation
1. Prepare a sufficient amount of XL1-Blue MRF' host culture, as described above, for the amount of screening planned. A culture of 100 mL is usually sufficient for screening 2-3 libraries.
2. Autoclave several bottles compatible with the QFil12 dispenser. These are the wide-mouth Corning bottles, 250 mL containing a sealing ring around the lip.
3. Make sure there are sufficient amounts of plates, top agar, BODIPY starch, red starch solution, etc. available for the screen.
4. Schedule the Day 2 robot run with a representative from Automation.

Day 1
1. Label the 1536-well plates (black) with library screen and plate number. Tough-Tags™ tube stickers, cut in half width-wise, are ideal for labeling 1536 well plates.
2. Calculate volumes of library, host cells and NZY medium necessary for the screen. This is easily done with an Excel spreadsheet.
3. Combine the calculated volumes of lambda library and OD5 host cells in a sterile 250 mL wide-mouth Corning bottle (containing a sealing ring).
4. Allow adsorption to occur at 37° C. for 15 minutes.
5. Add the calculated volume of NZY medium and mix well. This is referred to as the cell-phage-medium suspension.
6. Perform a concomitant titer by combining 50 uL of the cell-phage-medium suspension with 250 uL of OD1 host cells in a Falcon 2059 tube, then plating with 9 mL of top agar onto a 150 mm NZY plate. Incubate concomitant titer plate at 37° C. overnight.
7. Load the dispenser with the remainder of the suspension and array each labeled 1536-well plate at 4 uL per well. If the dispenser leaves air bubbles in some wells, they can be removed by centrifuging the plates at 200× g for 1 minute.
8. Add 0.5 uL of positive control phage to well position AD46 of at least two of the assay plates. Use a strong amylase-positive lambda clone for this purpose. The lambda versions of SEQ ID NO.: 113 or SEQ ID NO.: 199 are good choices for positive controls.
9. Incubate assay plates at 37° C. overnight in a humidified (≧95%) incubator.

Day 2
1. Count the pfu on the concomitant titer plate and determine the average seed density per well (in pfu per well).
2. Pintool at least 2 plates of each library screen (preferably the 2 containing positive controls) as follows:
   a) Prepare 2 host lawn plates to act as a surface on which to pintool: combine 250 uL of OD1 host cells with 2 mL 2% red starch and plate with 9 mL top agar onto 150 mm NZY plates. Hold each plate as level as possible as the top agar solidifies in order to produce an even hue of red across the plate.
   b) Using a twice flame-sterilized 1536 position pintool, replicate at least 2 of the screening plates onto the host lawn plates.
   c) Place the pintooled recipient plates in a laminar flow hood with the lids off for about 15-30 minutes (to vent off excess moisture).
   d) Replace the lids and incubate inverted at 37° C. overnight.
3. Prepare the 2×BODIPY starch substrate buffer as follows:
   a) Calculate the total volume of 2× substrate buffer solution needed for all screening plates at 4 uL per well (including any extra deadspace volume required by the dispenser) and measure this amount of 100 mM CAPS pH 10.4 into a vessel appropriate for the dispenser used.
   b) Retrieve enough 0.5 mg tubes of BODIPY starch to produce the required volume of 2× substrate buffer [calculated in step a) above] at a final concentration of 20-30 ug/mL.

c) Dissolve each 0.5 mg tube in 50 uL DMSO at room temperature, protected from light, with frequent vortexing. This takes more than 15 minutes; some production lots of BODIPY starch dissolve better than others.
d) Add 50 uL 100 mM CAPS buffer pH 10.4 to each tube and mix by vortexing.
e) Pool the contents of all tubes and remove any undissolved aggregates by centrifuging for 1 minute at maximum speed in a microfuge.
f) Add the supernatant to the rest of the 100 mM CAPS buffer measured in step a) above.
g) Protect the 2× substrate buffer from light by wrapping in foil.
4. Take plates and substrate buffer to the automation room and program the robot with the following parameters:
a) dispense 4 uL substrate buffer per well.
b) $1^{st}$ read at 1 hour post-substrate, $2^{nd}$ read at 9 hours, and third read at 17 hours; with 37° C. incubation between reads
c) excitation filter: 485 nm; emission filter: 535 nm
d) set the Spectrafluor gain at 70, or the optimal gain for the batch of 2× substrate buffer prepared.
e) ensure that the incubator used will protect assay plates from light.

Day 3
1. Check pintooled plates for clearings in the bacterial lawn at all positions corresponding to wells on the associated assay plate. Also check for clearings in the red starch in any of the pin positions. If plates containing positive controls were used for pintooling, you should be able to see a large clearing zone in the red background. Be wary of contaminants that also form clearing zones in red starch (see comment "Contaminants That Form Clearing Zones in Red Starch" at end of Example 7).
2. Identify putative hits from the data file produced by the robot computer. The KANAL program produced by Engineering simplifies data analysis. As a rule of thumb, a putative hit is characterized as a well having signal intensity rising at least 1.5 fold over background.
3. For each putative, remove 2 uL from the well and add to a tube containing 500 uL SM buffer and 50 uL CHCl3. Vortex to mix and store at 4° C. This solution will be referred to as the 4e-3 stock. The original screening plates should be stored at 4° C., protected from light, at least until breakouts are complete.

This is the recommended method of breaking out putative hits. It is a liquid phase assay that relies on confirmation of activity on BODIPY starch. Alternatively, putative hits can be plated directly onto solid phase plates containing red starch such that 2,000-3,000 pfu per hit are examined for clearing zones. However, inability to observe clearing zones on red starch is not necessarily an indication that a putative hit was a false positive. It would then need to be assayed using the format in which it was originally identified (i.e., liquid phase using BODIPY starch as substrate). In addition, very weak positives are more easily identified using the method detailed below.

Day 1
1. In a sterile 50 mL conical tube, combine 0.5 mL OD5 host cells with 45.5 mL NZY. This will be referred to as the host-medium suspension.
2. For each putative hit to be analyzed, aliquot 1 niL of host-medium suspension into each of 3 three sterile microfuge tubes.
3. Set the 12-channel pipetman in multidispense mode with an aliquot size of 20 uL and an aliquot number of 2×. Mount the pipetman with a clean set of sterile tips.
4. Pour about 1 mL of host-medium suspension into a new sterile solution basin and load the multichannel pipetman.
5. Dispense 20 uL per well into the last row (row P) of a black 384-well plate (12 channels×2=24 wells). This row will be used later for the controls.
6. Expel the remaining liquid in the tips by touching the tips against the surface of the basin and pressing the RESET button on the pipetman. Lay the pipetman down in a way to prevent contamination of the tips. There is no need to change the tips at this point.
7. Pour the remainder of the fluid in the basin into a waste container (like a beaker) taking care to avoid splash-back contamination.
8. For the first putative to be analyzed, take 111 µL of the 4e-3 stock (see Day 2 in Lambda Microtiter Screening for Amylases) and add it to the first in a set of three tubes containing 1 mL host-medium suspension (step 2). Vortex to mix. This is Dilution A.
9. Take 111 uL of Dilution A and add to the next tube in the set. Vortex to mix. This is Dilution B.
10. Take 111 uL of Dilution B and add to the last tube in the set. Vortex to mix. This is Dilution C. You should now have three dilutions of phage, where concentrations of each differ by a factor of 10.
11. Pour the contents of Dilution C (the most dilute of the 3 samples) into the solution basin and load the multichannel pipetman.
12. Dispense 20 uL per well into the first row of the 384-well plate (12 channels×2=24 wells).
13. Expel the remaining liquid in the tips by touching the tips against the surface of the basin and pressing the RESET button on the pipetman. Lay the pipetman down in a way to prevent contamination of the tips. There is no need to change the tips at this point.
14. Empty the basin as described above.
15. Pour the contents of Dilution B into the same basin and load the multichannel pipetman.
16. Dispense 20 uL per well into the second row of the 384-well plate.
17. Perform steps 13-16 similarly to dispense Dilution A into the third row of the plate.
18. After all three dilutions have been arrayed into the first 3 rows of the plate, discard all tips and the solution basin into the biohazardous waste container.
19. Mount the pipetman with a clean set of sterile tips and open a new sterile solution basin.
20. Repeat steps 8-19 for each remaining putative hit, using remaining rows on the plate up to row O. Five putative hits can be analyzed on one 384-well plate, with the last row (row P) saved for the controls.
21. Add 0.5 uL of each control to a separate well. Use at least 2-3 separate controls, preferably covering a range of activity.
22. Incubate assay plates at 37° C. overnight in a humidified (≧95%) incubator.

Day 2
1. Pintool all breakout plates onto a host lawn with red starch using the same method described for Day 2 in Lambda Microtiter Screening for Amylases, except that a 384 position pintool is used.
2. Prepare the 2×BODIPY starch substrate buffer as follows:
a) Calculate the total volume of 2× substrate buffer solution needed for all breakout plates at 20 uL per well (including any extra deadspace volume required by the dispenser) and measure this amount of 100 mM CAPS pH 10.4 into a vessel appropriate for the dispenser used.

b) Retrieve enough 0.5 mg tubes of BODIPY starch to produce the required volume of 2× substrate buffer [calculated in step a) above] at a final concentration of 20-30 ug/mL.
c) Dissolve each 0.5 mg tube in 50 uL DMSO at room temperature, protected from light, with frequent vortexing. This takes more than 15 minutes; some production lots of BODIPY starch dissolve better than others.
d) Add 50 uL 100 mM CAPS buffer pH 10.4 to each tube and mix by vortexing.
e) Pool the contents of all tubes and remove any undissolved aggregates by centrifuging for 1 minute at maximum speed in a microfuge.
f) Add the supernatant to the rest of the 100 mM CAPS buffer measured in step a) above.
g) Protect the 2× substrate buffer from light by wrapping in foil.
3. Dispense 20 uL per well into all breakout plates.
4. Wrap all plates in aluminum foil and incubate at room temperature for 2-6 hours.
5. Read each plate in the Spectrafluor with the following settings:
a) fluorescence read (excitation filter: 485 nm; emission filter: 535 nm)
b) plate definition: 384 well black
c) read from the top
d) optimal gain
e) number of flashes: 3
6. On the resulting Excel spreadsheet, chart each putative's 3 rows in a separate graph and check for activity. Ensure that the positives controls produced signals over background.
7. For each putative that appears to have a real signal among the wells, harvest a sample from a positive well as follows:
a) Select a positive well from a row representing the highest initial dilution.
b) Transfer 2 uL from that well into a tube containing 500 uL SM and 50 uL $CHCl_3$. This is referred to as the breakout stock.
c) Store at 4° C.
8. Using methods previously described, plate about 10 uL of each breakout stock onto 150 mm NZY plates using red starch. The objective is to obtain several (at least 20) well-separated plaques from which to core isolates.
Day 3
1. Check pintooled plates for an acceptable incidence of clearings in the bacterial lawn corresponding to wells on the associated assay plate. Also check for clearings in the red starch in the positive controls and in any tested putatives. Be wary of contaminants that also form clearing zones in red starch (see below).
2. From the solid phase plates containing dilutions of breakout stocks, core several isolated plaques, each into 500 uL SM with 50 uL $CHCl_3$. This is referred to as the isolate stock.
3. The isolate stocks can then be individually tested on BODIPY starch using methods described above. This step can be skipped if the plaque that was cored in step 2 produced a clearing zone in the red starch background. The isolate stocks were then be individually tested on BODIPY starch using methods described above. However, this step may be skipped if the plaque that was cored in step 2 produced a clearing zone in the red starch background.

Excisions
Day 1
1. In a Falcon 2059 tube, mix 200 uL OD1 XL1-Blue MRF' host, 100 uL lambda isolate stock and 1 uL ExAssist phage stock.
2. Incubate in 37° C. shaker for 15 minutes.
3. Add 3 mL NZY medium.
4. Incubate in 30° C. shaker overnight.
Day 2
1. Heat to excision tube to 70° C. for 20 minutes.
2. Centrifuge 1000×g for 10 minutes.
3. In a Falcon 2059 tube, combine 50 uL supernatant with 200 uL EXP505 OD1 host.
4. Incubate in 37° C. shaker for 15 minutes.
5. Add 300 uL SOB medium.
6. Incubate in 37 C shaker for 30-45 minutes.
7. Plate 50 uL on large $LB_{Kan50}$ plate using sterile glass beads. If the plates are "dry", extra SOB medium can be added to help disburse the cells.
8. Incubate plate at 30° C. for at least 24 hours.
9. Culture an isolate for sequencing and/or RFLP.
Growth at 30° C. reduces plasmid copy number and is used to mitigate the apparent toxicity of some amylase clones.

Contaminants that Form Clearing Zones in Red Starch

When using red starch on solid medium to assay phage for amylase activity, it is common to see contaminating colony forming units (cfu) that form clearing zones in the red starch. For pintooled plates, it is important to distinguish amylase-positive phage clones from these contaminants whenever they align with a particular well position. The source of the contaminating microbes is presumably the 2% red starch stock solution, which cannot be sterilized by autoclaving or by filtering after preparation. It is thought that they are opportunistic organisms that survive by metabolizing the red starch. In order to reduce these contaminants, use sterile technique when making 2% red starch solutions and store the stocks either at 4° C. or on ice.

Example 8

Bioinformatic Analysis

An Initial bioinformatic analysis was made with the known hyperthermophillic α-amylase sequences. FIG. 14a shows an alignment of the sequences some of which have been deposited at the NCBI database. This analysis revealed the potential for designing degenerate primers to PCR the entire gene minus its signal sequence (see FIG. 14a), yielding potentially novel full-length alpha amylases from a library.

The following libraries were screened by PCR from genomic DNA:

TABLE 6

| Library # | Name | PCR positive | Subcloned |
|---|---|---|---|
| 5 | A. lithotropicus | No | |
| 13 | Pyrodictium occultum | No | |
| 17 | Pyrodictium TAG11 | No | Yes |
| 113 | Deep sea enrichment | Yes | Yes |
| 170 | Deep sea enrichment | Yes | Yes |
| 198 | Archaeglobus | No | |
| 206 | Acidianus sp | No | |
| 453 | Mixed iceland enrich | No | |
| 455 | Mixed iceland enrich | Yes | Yes |

FIG. 14b shows an alignment of the identified sequences and the table below lists their relative percent identities.

TABLE 7

| | SEQ ID NO.: 81 | pyro | Pyro 2 | thermo | therm2 | SEQ ID NO.: 75 | SEQ ID NO.: 77 | SEQ ID NO.: 83 | SEQ ID NO.: 85 | SEQ ID NO.: 79 | Clone A |
|---|---|---|---|---|---|---|---|---|---|---|---|
| | Nucleotide sequence % identity | | | | | | | | | | |
| SEQ ID NO.: 81 | 100 | 91.7 | 75.1 | 82.1 | 80.1 | 82.5 | 82.6 | 82.1 | 82.6 | 83 | 77.8 |
| pyro | | 100 | 74.8 | 82.5 | 80.5 | 82 | 82.2 | 82.9 | 82.8 | 84 | 78.5 |
| Pyro2 | | | 100 | 71.5 | 71.1 | 74 | 74.2 | 77 | 77.1 | 73 | 70.5 |
| therm | | | | 100 | 81.7 | 83.5 | 83.8 | 82.8 | 83.2 | 83.8 | 76.4 |
| therm2 | | | | | 100 | 88.9 | 88.8 | 84.1 | 84.7 | 84 | 76.3 |
| SEQ ID NO.: 75 | | | | | | 100 | 98.3 | 84.6 | 85.2 | 85.5 | 77 |
| SEQ ID NO.: 77 | | | | | | | 100 | 84.8 | 84.9 | 85.4 | 77.4 |
| SEQ ID NO.: 83 | | | | | | | | 100 | 96 | 83.3 | 78.5 |
| SEQ ID NO.: 85 | | | | | | | | | 100 | 83 | 78.1 |
| SEQ ID NO.: 79 | | | | | | | | | | 100 | 79.8 |
| Clone A | | | | | | | | | | | 100 |

The amino acid identity ranges from about 85-98% identity. Accordingly, these sequences are useful in shuffling of genes as described herein.

FIG. 14c shows the nucleic acid alignment of the corresponding polypeptide sequences above. Expression of these amylases in the expression vector pSE420 and the host cell line XL1-Blue showed 1703 and 1706 to have amylase activity.

Example 9

Characterization of Library 63 GP-1 Alpha Amylase pH Optimum and Specific Activity Determination In initial experiments, the SEQ ID NO: 81 from Thermococcus showed that it was effective in both starch liquefaction for corn wet milling and desizing for textiles. This enzyme has a pH optimum of 4.5 to 5.0. At this lower pH, it is possible to use little or no calcium which lowers overall operating costs and less byproduct formation. In addition, at this low pH, there is decreased chemical usage and ion exchange load. The industry standard B. licheniformis amylase is suboptimal in both thermostability and pH optimum. The 63GP-1 amylase has a higher application specific activity compared to B. licheniformis amylase and therefore much less enzyme is required to hydrolyze a ton of starch (as much as 20-fold less enzyme can be used).

The pH optimum for the hydrolysis of starch was determined by reacting 50 uL of the GP-1, 0.35 U/ml, with a 100 ml of 1% soluble starch solution (0.0175 U/g of starch) for 30 minutes at 95 degrees C. The reducing ends generated in the liquefied starch solution were measured by the neocupronine assay, described herein. The percent hydrolysis of cornstarch was determined by measuring the number of sugar reducing ends produced with the neocupronine assay. Seventy grams of buffer solution (pH 4-7) was weighed and 100 ppm of calcium was added. Thirty grams of cornstarch was mixed into the buffer solution to form a starch slurry. The enzyme was added and the vessels sealed and incubated at 95 degrees C. for 30 minutes with an initial heating rate of six degrees C. per minute. A 1 ml sample was extracted from the reaction beakers and analyzed by the neocupronine assay. The optimum for GP-1 was between pH 4.5 and 5, while the commercial B. licheniformis amylase performed optimally at about pH 6.0.

Example 10

Amylase Ligation Reassembly

Nine fragments (each about 150 bp) were amplified from each of the parent clones SEQ ID NO.: 81, SEQ ID NO.: 77, SEQ ID NO.: 79, covering the whole open reading frame. The primers are provided in Table 8.

TABLE 8

| | SEQ ID NO: | |
|---|---|---|
| GAACACTAGTAGGAGGTAACTTATGGCAAAGTATTCCGAGCTCGAAG | 258 | SpeI |
| GAACGGTCTCATTCCGCCAGCCAGCAAGGGGATGAGCGG | 259 | BsaI |
| GAACCGTCTCAAAACACGGCCCATGCCTACGGC | 260 | BsmBI |
| GAACGTCTCACCTCGACTTCCACCCCAACGAGGTCAAG | 261 | BsmAI |
| GAACGTCTCAGGCGCTTTGACTACGTGAAGGGC | 262 | BsmAI |
| GAACGGTCTCAACAAGATGGATGAGGCCTTTG | 263 | BsaI |
| GAACCGTCTCACGATATAATCTGGAACAAGTACCTTGC | 264 | BsmBI |

TABLE 8-continued

| | SEQ ID NO: | |
|---|---|---|
| GAACCGTCTCAGAAGCACGAGCATAGTTTACTACG | 265 | BsmBI |
| GAACCGTCTCAAAGGTGGGTTTATGTGCCG | 266 | BsmBI |
| GAACGTCTCAGGAATCCAAATGGCGGATATTCCCGC | 267 | BsmAI |
| GAACGGTCTCAGTTTATCATATTGATGAGCTCC | 268 | BsaI |
| GAACCGTCTCAGAGGTAGTTGGCAGTATATTTG | 269 | BsmBI |
| GAACGTCTCACGCCAGGCATCAACGCCGATG | 270 | BsmAI |
| GAACGTCTCATTGTAGTAGAGCGGGAAGTC | 271 | BsmAI |
| GAACGGTCTCAATCGGTGTCGTGGTTTGCTAC | 272 | BsaI |
| GAACCGTCTCACTTCCACCTGCGAGGTGGTC | 273 | BsmBI |
| GAACCGTCTCACCTTCCAACCTTGCTCGAGC | 274 | BsmBI |
| TCGAGACTGACTCTCACCCAACACCGCAATAGC | 275 | |
| GAACACTAGTAGGAGGTAACTTATGGCCAAGTACCTGGAGCTCGAAGAGG | 276 | SpeI |
| GAACGGTCTCATTCCCCCGGCGAGCAAGGGC | 277 | BsaI |
| GAACCGTCTCAAAACACCGCCCACGCCTACGG | 278 | BsmBI |
| GAACGTCTCACCTCGACTTCCACCCCAAC | 279 | BsmAI |
| GAACGTCTCAGGCGCTTCGACTACGTCAAGG | 280 | BsmAI |
| GAACGGTCTCAACAAGATGGACGCGGCCTTTGAC | 281 | BsaI |
| GAACCGTCTCACGATATAATTTGGAACAAGTACCC | 282 | BsmBI |
| GAACCGTCTCAGAAGCACCGACATAGTCTAC | 283 | BsmBI |
| GAACCGTCTCAAAGGTGGGTCTACGTTCCG | 284 | BsmBI |
| GAACCGTCTCAGGAATCCATATTGCGGAGATTCCGGC | 285 | BsmAI |
| GAACGGTCTCAGTTTATCATGTTCACGAGCTC | 286 | BsaI |
| GAACCGTCTCAGAGGTAGTTGGCCGTGTACTTG | 287 | BsmBI |
| GAACGTCTCAGCCATGCGTCAACGCCGATG | 288 | BsmAI |
| GAACGTCTCATTGTAGTAGAGCGGGAAGTCG | 289 | BsmAI |
| GAACGGTCTCAATCGGTGTCGTGGTTTGCAACG | 290 | BsaI |
| GAACCGTCTCACTTCCACCGGCGAGGTGGTCGTG | 291 | BsmBI |
| GAACCGTCTCACCTTCCGGCCTTGCTCGAGCC | 292 | BsmBI |
| TCGAGACTGACTCTCAGCCCACCCCGCAGTAGCTC | 293 | |
| GAACACTAGTAGGAGGTAACTTATGGCCAAGTACTCCGAGCTGGAAGAGG | 294 | SpeI |
| GAACGGTCTCATTCCTCCCGCGAGCAAGGG | 295 | BsaI |
| GAACCGTCTCAAAACACCGCCCACGCCTATG | 296 | BsmBI |
| GAACGTCTCACCTCGACTTCCACCCGAACGAGC | 297 | BsmAI |
| GAACGTCTCAGGCGCTTCGACTACGTCAAGG | 298 | BsmAI |
| GAACGGTCTCAACAAGATGGACGAGGCCTTCG | 299 | BsaI |
| GAACCGTCTCACGATATAATCTGGAACAAG | 300 | BsmBI |
| GAACCGTCTCAGAAGCACTGACATCGTTTACTACG | 301 | BsmBI |
| GAACCGTCTCAAAGGTGGGTTTACGTTCCG | 302 | BsmBI |
| GAACGTCTCAGGAATCCATATCGCCGAAAT | 303 | BsmAI |

TABLE 8-continued

| | SEQ ID NO: | |
|---|---|---|
| GAACGGTCTCAGTTTATCATGTTTATGAGC | 304 | BsaI |
| GAACCGTCTCAGAGGTAGTTGGCCGTGTATTTAC | 305 | BsmBI |
| GAACGTCTCACGCCAGGCATCGATGCCGAT | 306 | BsmAI |
| GAACGTCTCATTGTAGTAGAGGGCGAAGTCAAAG | 307 | BsmAI |
| GAACGGTCTCAATCGGTATCGTGGTTGGCTACAAAC | 308 | BsaI |
| GAACCGTCTCACTTCCTCCGGCGAGGTTGTCATG | 309 | BsmBI |
| GAACCGTCTCACCTTCCGGCTTTGCTTGAGGC | 310 | BsmBI |
| TCGAGACTGACTCTCACCCAACACCGCAGTAGCTCC | 311 | |
| CACACAGCAGCAACCAACCTCGAGACTGACTCTCASCC | 312 | BbvI |

Conditions used for PCR were as follows: 3 min 94° C., (30 sec 94° C.; 30 sec 55° C., 30 sec 68° C.)×30 cycles, followed by 10 min 68° C. PCR products corresponding to homologous regions from the three parents were pooled (1:1:1), cut with the appropriate restriction enzyme (see Table 8), and gel-purified. Equal amounts of fragment pools were combined and ligated (16° C.; over night). The resulting 450 bp ligation products were gel purified and ligated to yield full length amylase genes. The resulting full length products were gel-purified and PCR amplified using a mixture of F1 primers SEQ ID NO.: 81, SEQ ID NO.: 77, SEQ ID NO.: 79 and primer (SEQ ID NO: 312). Conditions used for PCR were as follows: 3 min 94° C., (30 sec 94° C.; 30 sec 50° C., 60 sec 68° C.)×30 cycles, followed by 10 min 68° C. The resulting PCR products (~1.4 kbp) were purified, cut with SpeI and BbvI, gel-purified, ligated into pMYC (vector from Mycogen, cut with SpeI/XhoI), and transformed into E. coli Top10. Plasmid DNA from a pool of ~21000 colonies was isolated and transformed into Pseudomonas.

Screening of Reassembled α-amylase

The transformed Pseudomonas fluorescens (MB214) containing pMYC derived from the parent clones SEQ ID NO.: 81, SEQ ID NO.: 77, SEQ ID NO.: 79 were sorted to 96- or 384-well plates by FACS and treated with 6M urea. Primary screening using RBB-starch and/or FITC-starch as substrates was carried out as described more fully below. Elevated active clones were screened using RBB-starch as substrate using induced cultures and by liquefaction assay. Stock and sequencing new elevated active clones based on liquefaction data was performed.

The transformed reassembled amylase library (MB214 (Pf)), were collected and sorted into 96-well plates (or 384-well plates) at 1 cell/well in 50 µl of LB+Tet. The plates were incubated for 24 hours at 30° C. Replicate plates were made corresponding to each well for storage. Forty-five (45) µl of 12M urea was added to each well and the plates were shaken for 10 minutes. Plates were kept at room temp for at least 1 hour and the lysate stored at 4° C.

Assay Using RBB-starch

75 µl of RBB-starch substrate (1% RBB-insoluble corn starch in 50 mM NaAc buffer, pH=4.5) was added into each well of a new 96-well plate (V-bottom). Five micro-liters of enzyme lysate was transfered into each well with substrate using Biomek or Zymark. The plates were sealed with aluminum sealing tape and shaken briefly on the shaker. The plates were incubated at 90° C. for 30 minutes, followed by cooling at room temperature for about 5 to 10 minutes. One hundred micro-liters of 100% ethanol was added to each well, the plates sealed and shaken briefly on the shaker. The plates were then centrifuged 4000 rpm for 20 minutes using benchtop centrifuge. 100 µl of the supernatant was transferred into a new 96-well plate (flat bottom) by Biomek and read $OD_{595}$. Controls: SEQ ID NO.: 81, SEQ ID NO.: 77, SEQ ID NO.: 79.

Assay Using FITC-starch

Added 50 µl of substrate (0.01% FITC-starch in 100 mM NaAc buffer, pH=4.5) into each well of a new 384-well plate. Transfered 5 µl of enzyme lysate into each well with substrate and incubated the plate at room temperature overnight. The polarization change of the substrate, excitation 485 nm, emission 535 nm, was read for each well. Controls: SEQ ID NO.: 81, SEQ ID NO.: 77, SEQ ID NO.: 79. Preferably 96 well plates are used for all assays.

Confirmation of New Active Clones

Each positive clone from screening was grown and induced using a standard protocol. Each clone was examined for growth (i.e., cell density over time), activity at per cell level (RBB-starch assay and liquefaction assay), expression (protein gel) and solubility of protein (by microscope analysis). The confirmed new elevated clones were transferred for fermentation.

TABLE 3

| SEQ ID NO. | Signal Sequence |
|---|---|
| SEQ ID NO: 87 | AA1-23 (SEQ ID NO: 213) |
| SEQ ID NO: 91 | AA1-23 (SEQ ID NO: 214) |
| SEQ ID NO: 93 | AA1-33 (SEQ ID NO: 215) |
| SEQ ID NO: 97 | AA1-31 (SEQ ID NO: 216) |
| SEQ ID NO: 99 | AA1-30 (SEQ ID NO: 217) |
| SEQ ID NO: 103 | AA1-22 (SEQ ID NO: 218) |
| SEQ ID NO: 105 | AA1-33 (SEQ ID NO: 219) |
| SEQ ID NO: 109 | AA1-25 (SEQ ID NO: 220) |
| SEQ ID NO: 111 | AA1-35 (SEQ ID NO: 221) |
| SEQ ID NO: 113 | AA1-28 (SEQ ID NO: 222) |
| SEQ ID NO: 117 | AA1-21 (SEQ ID NO: 223) |
| SEQ ID NO: 119 | AA1-30 (SEQ ID NO: 224) |
| SEQ ID NO: 123 | AA1-35 (SEQ ID NO: 225) |
| SEQ ID NO: 125 | AA1-28 (SEQ ID NO: 226) |
| SEQ ID NO: 127 | AA1-30 (SEQ ID NO: 227) |

TABLE 3-continued

| SEQ ID NO. | Signal Sequence |
|---|---|
| SEQ ID NO: 131 | AA1-30 (SEQ ID NO: 228) |
| SEQ ID NO: 133 | AA1-30 (SEQ ID NO: 229) |
| SEQ ID NO: 137 | AA1-28 (SEQ ID NO: 230) |
| SEQ ID NO: 139 | AA1-23 (SEQ ID NO: 231) |
| SEQ ID NO: 141 | AA1-23 (SEQ ID NO: 232) |
| SEQ ID NO: 143 | AA1-30 (SEQ ID NO: 233) |
| SEQ ID NO: 145 | AA1-27 (SEQ ID NO: 234) |
| SEQ ID NO: 147 | AA1-29 (SEQ ID NO: 235) |
| SEQ ID NO: 149 | AA1-28 (SEQ ID NO: 236) |
| SEQ ID NO: 69 | AA1-27 (SEQ ID NO: 237) |
| SEQ ID NO: 153 | AA1-26 (SEQ ID NO: 238) |
| SEQ ID NO: 155 | AA1-33 (SEQ ID NO: 239) |
| SEQ ID NO: 157 | AA1-25 (SEQ ID NO: 240) |
| SEQ ID NO: 159 | AA1-25 (SEQ ID NO: 241) |
| SEQ ID NO: 161 | AA1-36 (SEQ ID NO: 242) |
| SEQ ID NO: 167 | AA1-36 (SEQ ID NO: 243) |
| SEQ ID NO: 169 | AA1-23 (SEQ ID NO: 244) |

TABLE 3-continued

| SEQ ID NO. | Signal Sequence |
|---|---|
| SEQ ID NO: 173 | AA1-25 (SEQ ID NO: 245) |
| SEQ ID NO: 175 | AA1-22 (SEQ ID NO: 246) |
| SEQ ID NO: 177 | AA1-23 (SEQ ID NO: 247) |
| SEQ ID NO: 179 | AA1-23 (SEQ ID NO: 248) |
| SEQ ID NO: 185 | AA1-25 (SEQ ID NO: 249) |
| SEQ ID NO: 189 | AA1-36 (SEQ ID NO: 250) |
| SEQ ID NO: 191 | AA1-25 (SEQ ID NO: 251) |
| SEQ ID NO: 193 | AA1-25 (SEQ ID NO: 252) |
| SEQ ID NO: 197 | AA1-23 (SEQ ID NO: 253) |
| SEQ ID NO: 199 | AA1-23 (SEQ ID NO: 254) |
| SEQ ID NO: 201 | AA1-30 (SEQ ID NO: 255) |
| SEQ ID NO: 203 | AA1-25 (SEQ ID NO: 256) |
| SEQ ID NO: 205 | AA1-16 (SEQ ID NO: 257) |
| SEQ ID NO.: 73 | AA1-16 (SEQ ID NO: 7) |
| SEQ ID NO.: 79 | AA1-26 (SEQ ID NO: 8) |

SEQUENCE LISTING (321 sequences)

SEQ ID NO: 1 - DNA, 1311 bp, Artificial Sequence
  synthetically generated oligonucleotide
atggcaaagtattccgagctcgaagagggcgggctcataatgcaggccttctactgggacgtccccatgggaggaatctggtgggacacgatagcccagaagatacccgactgggcaagcgccgggatttcggcgatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacaccgcccacgcctatggcatgaaggtaatagccgatatagtcatcaaccaccgcgccggcggtgacctggagtggaaccccttcgtgaacgactatacctggaccgacttctcaaaggtcgcgtcgggtaaatacacggccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctacggagcgtgggtcgtcaaggactggctggactggtggggaggctgggccgtcggggagtactgggacacaaacgttgatgcactgctcaactgggcctactcgagcgatgcaaaagtcttcgacttcccgctctactacaagatggacgcggcctttgacaacaagaacattcccgcactcgtcgaggccctcaagaacgggggcacagtcgtcagccgcgacccgtttaaggccgtaaccttcgttgcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcactgacatcgtttactacgacaacgacgagctgatattcgtgagaaacggctacggaagcaagccgggactgataacatacatcaacctcgcctcaagcaaagccggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctactgcggtgttgggtga

SEQ ID NO: 2 - protein, 436 aa, Artificial Sequence
  synthetically generated polypeptide
MAKYSELEEGGLIMQAFYWDVPMGGIWWDTIAQKIPDWASAGISAIWIPPASKGMGGAYSMGYDPYDFFDLGEYDQKGTVETRFGSKQELVNMINTAHAYGMKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYGAWVVKDWLDWWGGWAVGEYWDTNVDALLNWAYSSDAKVFDFPLYYKMDAAFDNKNIPALVEALKNGGTVVSRDPFKAVTFVANHDTDIIWNKYPAYAFILTYEGQPTIFYRDYEEWLNKDKLKNLIWIHDNLAGGSTDIVYYDNDELIFVRNGYGSKPGLITYINLASSKAGRWVYVPKFAGSCIHEYTGNLGGWVDKWVDSSGWVYLEAPAHDPANGQYGYSVWSYCGVG

SEQ ID NO: 3 - DNA, 1311 bp, Artificial Sequence
  synthetically generated oligonucleotide
atggccaagtacctggagctcgaagagggcgggctcataatgcaggccttctactgggacgtccccatgggaggaatctggtgggacacgatagcccagaagatacccgactgggcaagcgccgggatttcggcgatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacaccgcccacgcctacggcatcaaggtcatcgcagacatagtaatcaaccaccgcgccggaggagaccttgagtggaaccccttcgtcaatgactacacctggacggacttctcgaaggtcgcttccggcaagtacacggccaattacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcactgacatcgtttactacgacaacgacgagctgatattcgtgagaaacggctacggaagcaagccgggactgataacatacatcaacctcgcctcaagcgaagccggaaggtgggtctacgttccgaagttcgcgggagcgtgcatccacgagtacaccggcaacctcggcggctgggtggacaagtgggtggactcaagcgggtgggtgtacctcgaggcccctgcccacgacccggccaacggctattacggctactccgtctggagctattgcggtgttgggtga

SEQ ID NO: 4 - protein, 436 aa, Artificial Sequence
  synthetically generated polypeptide
MAKYLELEEGGLIMQAFYWDVPMGGIWWDTIAQKIPDWASAGISAIWIPPASKGMGGAYSMGYDPYDFFDLGEYDQKGTVETRFGSKQELVNMINTAHAYGIKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNKNIPALVSALQNGQTVVSRDPFKAVTFVANHDTDIIWNKYPAYAFILTYEGQPTIFYRDYEEWLNKDKLKNLIWIHDNLAGGSTDIVYYDNDELIFVRNGYGSKPGLITYINLASSEAGRWVYVPKFAGACIHEYTGNLGGWVDKWVDSSGWVYLEAPAHDPANGYYGYSVWSYCGVG

SEQ ID NO: 5 - DNA, 1311 bp, Artificial Sequence
  synthetically generated oligonucleotide
atggccaagtactccgagctggaagagggcggcgttataatgcaggccttctactgggacgtcccaggtggaggaatctggtgggacaccatcaggagcaagataccggagtggtacgaggcgggaatatccgccatttggattcccccggcaagcaagggcatgggcggcgcctattcgatgggctacgacccctacgacttctttgacctcggtgagtacgaccagaagggaacggtagagacgcgctttggctccaagcaggagctcgtgaacatgataaacaccgcccacgcctatggcatgaaggtaatagccgatatagtcatcaaccaccgcgccggcggtgacctggagtggaaccccttcgtgaacgactatacctggaccgacttctcaaaggtcgcgtcgggtaaatacacggccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtaccttgcttatgctttcatcctcacctacgaaggccagcccgtcatattctaccgcgaccacgaggagtggctcaacaaggacaggttgaacaacctcatatggatacacgaccacctcgcaggtggaagcaccgacatagtctactacgataacgatgaactcatcttcgtcaggaacggctacggggacaagccggggcttataacctacatcaacctaggctcgagcaaggccggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctactgcggggtgggctga

SEQ ID NO: 6 - protein, 436 aa, Artificial Sequence
  synthetically generated polypeptide
MAKYSELEEGGVIMQAFYWDVPGGGIWWDTIRSKIPEWYEAGISAIWIPPASKGMGGAYSMGYDPYDFFDLGEYDQKGTVETRFGSKQELVNMINTAHAYGMKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNKNIPALVSALQNGQTVVSRDPFKAVTFVANHDTDIIWNKYLAYAFILTYEGQPVIFYRDHEEWLNKDRLNNLIWIHDHLAGGSTDIVYYDNDELIFVRNGYGDKPGLITYINLGSSKAGRWVYVPKFAGACIHEYTGNLGGWVDKYVYSSGWVYLEAPAYDPANGQYGYSVWSYCGVG

SEQ ID NO: 7 - protein, 16 aa, Environmental
MALEEGGLIMQAFYWD

SEQ ID NO: 8 - protein, 26 aa, Bacterial
MKPAKLLVFVLVVSILAGLYAQPAGA

SEQ ID NO: 9 - DNA, 1311 bp, Artificial Sequence
  synthetically generated oligonucleotide
atggccaagtactccgagctggaagagggcgggctcataatgcaggccttctactgggacgtccccatgggaggaatctggtgggacacgatagcccagaagatacccgactgggcaagcgccgggatttcggcgatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggacgaggccttcgataacaacaacattcccgccctggtggacgccctcagatacggtcagacagtggtcagccgcgacccgttcaaggctgtgacgtttgtagccaaccacgataccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcactgacatcgtttactacgacaacgacgagctgatattcgcgagaaacggctacggaagcaagccgggactgataacatacatcaacctcgcctcaagcaaagccggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctactgcggtgttgggtga

SEQ ID NO: 10 - protein, 436 aa, Artificial Sequence
  synthetically generated polypeptide
MAKYSELEEGGLIMQAFYWDVPMGGIWWDTIAQKIPDWASAGISAIWIPPASKGMGGAYSMGYDPYDFFDLGEYDQKGTVETRFGSKQELVNMINTAHAYGIKVIADIVINHRAGGDLEWNPFVGDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNNNIPALVDALRYGQTVVSRDPFKAVTFVANHDTDIIWNKYPAYAFILTYEGQPTIFYRDYEEWLNKDKLKNLIWIHDNLAGGSTDIVYYDNDELIFARNGYGSKPGLITYINLASSKAGRWVYVPKFAGSCIHEYTGNLGGWVDKWVDSSGWVYLEAPAHDPANGQYGYSVWSYCGVG

SEQ ID NO: 11 - DNA, 1311 bp, Artificial Sequence
  synthetically generated oligonucleotide
atggccaagtacctggagctcgaggagggcgggctcataatgcaggccttctactgggacgtccccatgggaggaatctggtgggacacgatagcccagaagatacccgactgggcaagcgccgggatttcggcgatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacaccgcccacgcctatggcatgaaggtaatagccgatatagtcatcaaccaccgcgccggcggtgacctggagtggaaccccttcgtgaacgactatacctggaccgacttctcaaaggtcgcgtcgggtaaatacacggccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggacgaggccttcgataacaacaacattcccgccctggtggacgccctcagatacggtcagacagtggtcagccgcgacccgttcaaggctgtgacgtttgtagccaaccacgataccgatataatctggaacaagtatccagcctacgcgttcatcctcacctacgagggccagccgacaatattctaccgcgactacgaggagtggctcaacaaggatacgctcaagaacctcatctggatacatgacaacctcgccggaggaagcacgagcatagtttactacgacagcgacgagatgatcttcgtgaggaacggctatggaagcaagcctggccttataacttacatcaacctcggctcgagcaaggttggaaggtgggtctacgttccgaagttcgcgggagcgtgcatccacgagtacaccggcaacctcggcggctgggtggacaagtgggtggactcaagcgggtgggtgtacctcgaggcccctgcccacgacccggccaacggctattacggctactccgtctggagctactgcggtgttggctga

SEQ ID NO: 12 - protein, 436 aa, Artificial Sequence
  synthetically generated polypeptide
MAKYLELEEGGLIMQAFYWDVPMGGIWWDTIAQKIPDWASAGISAIWIPPASKGMGGAYSMGYDPYDFFDLGEYDQKGTVETRFGSKQELVNMINTAHAYGMKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNNNIPALVDALRYGQTVVSRDPFKAVTFVANHDTDIIWNKYPAYAFILTYEGQPTIFYRDYEEWLNKDTLKNLIWIHDNLAGGSTSIVYYDSDEMIFVRNGYGSKPGLITYINLGSSKVGRWVYVPKFAGACIHEYTGNLGGWVDKWVDSSGWVYLEAPAHDPANGYYGYSVWSYCGVG

SEQ ID NO: 13 - DNA, 1311 bp, Artificial Sequence
  synthetically generated oligonucleotide
atggccaagtacctggagctcgaagagggcggggtcataatgcaggcgttctactgggacgtgccttcaggaggaatatggtgggacacaatacggcagaagataccggagtggtacgatgccggaatctccgcaatatggattcccccggcgagcaagggcatgggcggcgcctattcgatgggctacgacccctacgacttctttgacctcggtgagtatgaccagaagggaacggtagagacgcgctttggctccaagcaggagctcgtgaacatgataaacacggcacatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgcttcgactacgtcaagggctacggagcgtgggtcgtcaaggactggctggactggtggggaggctgggccgtcggggagtactgggacacaaacgttgatgcactgctcaactgggcctactcgagcgatgcaaaagtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcactgacatagtctactacgataacgatgaactcatcttcgtcaggaacggctacggggacaagccggggcttataacctacatcaacctaggctcgagcaaggccggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctactgcggtgttggctga

SEQ ID NO: 14 - protein, 436 aa, Artificial Sequence
  synthetically generated polypeptide
MAKYLELEEGGVIMQAFYWDVPSGGIWWDTIRQKIPEWYDAGISAIWIPPASKGMGGAYSMGYDPYDFFDLGEYDQKGTVETRFGSKQELVNMINTAHAYGIKVIADIVINHRAGGDLEWNPFVGDYTWTDFSKVASGKYTANYLDFHPNEVKCCDEGTFGGFPDIAHEKSWDQHWLWASDESYAAYLRSIGVDAWRFDYVKGYGAWVVKDWLDWWGGWAVGEYWDTNVDALLNWAYSSDAKVFDFPLYYKMDEAFDNKNIPALVSALQNGQTVVSRDPFKAVTFVANHDTDIIWNKYPAYAFILTYEGQPTIFYRDYEEWLNKDKLKNLIWIHDNLAGGSTDIVYYDNDELIFVRNGYGDKPGLITYINLGSSKAGRWVYVPKFAGACIHEYTGNLGGWVDKYVYSSGWVYLEAPAYDPANGQYGYSVWSYCGVG

SEQ ID NO: 15 - DNA, 1311 bp, Artificial Sequence
  synthetically generated oligonucleotide
atggccaagtactccgagctggaagagggcgggctcataatgcaggccttctactgggacgtccccatgggaggaatctggtgggacacgatagcccagaagatacccgactgggcaagcgccgggatttcggcgatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctacggagcgtgggtcgtcaaggactggctggactggtggggaggctgggccgtcggggagtactgggacacaaacgttgatgcactgctcaactgggcctactcgagcgatgcaaaagtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatttggaacaagtacccggcctacgccttcatcctcacctacgagggccagccgacgatattctaccgcgactacgaggagtggctcaacaaggacaggctcaagaacctcatctggatacacgaccaccttgccggtggaagcactgacatcgtttactacgacaacgacgagctgatattcgtgagaaacggctacggaagcaagccgggactgataacatacatcaacctcgcctcaagcaaagccggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctattgcggtgttgggtga

SEQ ID NO: 16 - protein, 436 aa, Artificial Sequence
  synthetically generated polypeptide
MAKYSELEEGGLIMQAFYWDVPMGGIWWDTIAQKIPDWASAGISAIWIPPASKGMGGAYSMGYDPYDFFDLGEYDQKGTVETRFGSKQELVNMINTAHAYGIKVIADIVINHRAGGDLEWNPFVGDYTWTDFSKVASGKYTANYLDFHPNELHAGDSGTFGGYPDICHDKSWDQYWLWASQESYAAYLRSIGIDAWRFDYVKGYGAWVVKDWLDWWGGWAVGEYWDTNVDALLNWAYSSDAKVFDFPLYYKMDEAFDNKNIPALVSALQNGQTVVSRDPFKAVTFVANHDTDIIWNKYPAYAFILTYEGQPTIFYRDYEEWLNKDRLKNLIWIHDHLAGGSTDIVYYDNDELIFVRNGYGSKPGLITYINLASSKAGRWVYVPKFAGACIHEYTGNLGGWVDKYVYSSGWVYLEAPAYDPANGQYGYSVWSYCGVG

SEQ ID NO: 17 - DNA, 1311 bp, Artificial Sequence
  synthetically generated oligonucleotide
atggccaagtactccgagctggaagggggcgggctcataatgcaggccttctactgggacgtccccatgggaggaatctggtgggacacgatagcccagaagatacccgactgggcaagcgccgggatttcggcgatatggattcccccggcgagcaagggcatgggcggcgcctattcgatgggctacgacccctacgacttctttgacctcggtgagtacgaccaggagggaacggtagagacgcgctttggctccaagcaggagctcgtgaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgcttcgactacgtcaagggctacggagcgtgggtcgtcaaggactggctggactggtggggaggctgggccgtcggggagtactgggacacaaacgttgatgcactgctcaactgggcctactcgagcgatgcaaaagtcttcgacttcccgctctactacaagatggacgcggcctttgacaacaagaacattcccgcactcgtcgaggccctcaagaacgggggcacagtcgtcagccgcgacccgtttaaggccgtaaccttcgttgcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcacgagcatagtttactacgacagcgacgagatgatcttcgtgaggaacggctatggaagcaagcctggccttataacttacatcaacctcggctcgagcaaggttggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctactgcggtgttgggtga

SEQ ID NO: 18 - protein, 436 aa, Artificial Sequence
  synthetically generated polypeptide
MAKYSELEGGGLIMQAFYWDVPMGGIWWDTIAQKIPDWASAGISAIWIPPASKGMGGAYSMGYDPYDFFDLGEYDQEGTVETRFGSKQELVNMINTAHAYGIKVIADIVINHRAGGDLEWNPFVGDYTWTDFSKVASGKYTANYLDFHPNEVKCCDEGTFGGFPDIAHEKSWDQHWLWASDESYAAYLRSIGVDAWRFDYVKGYGAWVVKDWLDWWGGWAVGEYWDTNVDALLNWAYSSDAKVFDFPLYYKMDAAFDNKNIPALVEALKNGGTVVSRDPFKAVTFVANHDTDIIWNKYPAYAFILTYEGQPTIFYRDYEEWLNKDKLKNLIWIHDNLAGGSTSIVYYDSDEMIFVRNGYGSKPGLITYINLGSSKVGRWVYVPKFAGSCIHEYTGNLGGWVDKWVDSSGWVYLEAPAHDPANGQYGYSVWSYCGVG

SEQ ID NO: 19 - DNA, 1311 bp, Artificial Sequence
  synthetically generated oligonucleotide
atggccaagtacctggagctcgaagagggcgggctcataatgcaggccttctactgggacgtccccatgggaggaatctggtgggacacgatagcccagaagatacccgactgggcaagcgccgggatttcggcgatatggattcctcccgcgagcaagggtatgagcggcggctattcgatgggctacgacccctacgattattttgaccttggtgagtactaccagaagggaacggtggaaacgaggttcggctcaaagcaggagctcataaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtgggggggctgggcggttggagagtactgggacaccaacgtcgacgctgttctcaactgggcatactcgagcggtgccaaggtctttgacttcgccctctactacaagatggatgaggcctttgacaacaaaaacattccagcgctcgtctctgcccttcagaacggccagactgttgtctcccgcgacccgttcaaggccgtaacctttgtagcaaaccacgacaccgatataatttggaacaagtacccggcctacgccttcatcctcacctacgagggccagccgacgatattctaccgcgactacgaggagtggctcaacaaggacaggctcaagaacctcatctggatacacgaccacctcgccggtggaagcactgacatcgtttactacgacaacgacgagctgatattcgtgagaaacggctacggaagcaagccgggactgataacatacatcaacctcgcctcaagcaaagccggaaggtgggtttatgtgccgaagttcgcgggcgcgtgcatccacgagcatactggtaacctcggaggctgggtagacaagtacgtctactcaagcggctgggtctatctcgaagctccagcttacgaccctgccaacgggcagtatggctactccgtgtggagctactgcggtgttggctga

SEQ ID NO: 20 - protein, 436 aa, Artificial Sequence
  synthetically generated polypeptide
MAKYLELEEGGLIMQAFYWDVPMGGIWWDTIAQKIPDWASAGISAIWIPPASKGMSGGYSMGYDPYDYFDLGEYYQKGTVETRFGSKQELINMINTAHAYGIKVIADIVINHRAGGDLEWNPFVGDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNKNIPALVSALQNGQTVVSRDPFKAVTFVANHDTDIIWNKYPAYAFILTYEGQPTIFYRDYEEWLNKDRLKNLIWIHDHLAGGSTDIVYYDNDELIFVRNGYGSKPGLITYINLASSKAGRWVYVPKFAGACIHEHTGNLGGWVDKYVYSSGWVYLEAPAYDPANGQYGYSVWSYCGVG

SEQ ID NO: 21 - DNA, 1311 bp, Artificial Sequence
  synthetically generated oligonucleotide
atggccaagtactccgagctggaagagggcggcgttataatgcaggccttctactgggacgtcccaggtggaggaatctggtgggacaccatcaggagcaagataccggagtggtacgaggcgggaatatccgccatttggattcctcccgggagcaagggtatgagcggcggctattcgatgggctacgacccctacgatgatttggacctgggtgagtactaccagaagggaacggtggaaacgaggttcggctcaaagcaggagctcataaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccacccgaacgagctccatgcgggcgattccggaacatttggaggctatcccgacatatgccacgacaagagctgggaccagtactggctctgggccagccaggagagctacgcggtatatctcaggagcatcggcatcgatgcctggcgcttcgactacgtcaagggctacggagcgtgggtcgtcaaggactggctggactggtggggaggctgggccgtcggggagtactgggacacaaacgttgatgcactgctcaactgggcctactcgagcgatgcaaaagtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatttggaacaagtacccggcctacgccttcatcctcacctacgagggccagccgacgatattctaccgcgactacgaggagtggctcaacaaggacaggctcaagaacctcatctggatacacgactacctcgccggtggaagcactgacatcgtttactacgacaacgacgagctgatattcgtgagaaacggctacggaagcaagccgggactgataacatacatcaacctcgcctcaagcaaagccggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctattgcggtgttggctga

SEQ ID NO: 22 - protein, 436 aa, Artificial Sequence
  synthetically generated polypeptide
MAKYSELEEGGVIMQAFYWDVPGGGIWWDTIRSKIPEWYEAGISAIWIPPGSKGMSGGYSMGYDPYDDLDLGEYYQKGTVETRFGSKQELINMINTAHAYGIKVIADIVINHRAGGDLEWNPFVGDYTWTDFSKVASGKYTANYLDFHPNELHAGDSGTFGGYPDICHDKSWDQYWLWASQESYAVYLRSIGIDAWRFDYVKGYGAWVVKDWLDWWGGWAVGEYWDTNVDALLNWAYSSDAKVFDFPLYYKMDEAFDNKNIPALVSALQNGQTVVSRDPFKAVTFVANHDTDIIWNKYPAYAFILTYEGQPTIFYRDYEEWLNKDRLKNLIWIHDYLAGGSTDIVYYDNDELIFVRNGYGSKPGLITYINLASSKAGRWVYVPKFAGACIHEYTGNLGGWVDKYVYSSGWVYLEAPAYDPANGQYGYSVWSYCGVG

SEQ ID NO: 23 - DNA, 1311 bp, Artificial Sequence
  synthetically generated oligonucleotide
atggccaagtactccgagctggaagagggcggcgttatagtgcaggccttctactgggacgtcccaggtggaggaatctggtgggacaccatcaggagcaagataccggagtggtacgaggcgggaatatccgccatttggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctacggagcgtgggtcgtcaaggactggctggactggtggggaggctgggccgtcggggagtactgggacacaaacgttgatgcactgctcaactgggcctactcgagcgatgcaaaagtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcatgagcatagtttactacgacagcgacgagatgatcttcgtgaggaacggctatggaagcaagcctggccttataacttacatcaacctcggctcgagcaaggttggaaggtgggtctacgttccgaagttcgcgggagcgtgcatccacgagtacaccggcaacctcggcggctgggtggacaagtgggtggactcaagcgggtgggtgtacctcgaggcccctgcccacgacccggccaacggctattacggctactccgtctggagctattgcggtgttggctga

SEQ ID NO: 24 - protein, 436 aa, Artificial Sequence
  synthetically generated polypeptide
MAKYSELEEGGVIVQAFYWDVPGGGIWWDTIRSKIPEWYEAGISAIWIPPASKGMGGAYSMGYDPYDFFDLGEYDQKGTVETRFGSKQELVNMINTAHAYGIKVIADIVINHRAGGDLEWNPFVGDYTWTDFSKVASGKYTANYLDFHPNELHAGDSGTFGGYPDICHDKSWDQYWLWASQESYAAYLRSIGIDAWRFDYVKGYGAWVVKDWLDWWGGWAVGEYWDTNVDALLNWAYSSDAKVFDFPLYYKMDEAFDNKNIPALVSALQNGQTVVSRDPFKAVTFVANHDTDIIWNKYPAYAFILTYEGQPTIFYRDYEEWLNKDKLKNLIWIHDNLAGGSMSIVYYDSDEMIFVRNGYGSKPGLITYINLGSSKVGRWVYVPKFAGACIHEYTGNLGGWVDKWVDSSGWVYLEAPAHDPANGYYGYSVWSYCGVG

SEQ ID NO: 25 - DNA, 1311 bp, Artificial Sequence
  synthetically generated oligonucleotide
atggccaagtacctggagctcgaagagggcgggctcataatgcaggccttctactgggacgtccccatgggaggaatctggtgggacacgatagcccagaagatacccgactgggcaagcgccgggatttcggcgatatggattcctcccgcgagcaagggtatgagcggcggctattcgatgggctacgacccctacgattattttgacctcggtgagtactaccagaagggaacggtggaaacgaggttcggctcaaagcaggagctcataaacatgataaacaccgcccacgcctatggcatgaaggtaatagccgatatagtcatcaaccaccgcgccggcggtgacctggagtggaaccccttcgtgaacgactatacctggaccgacttctcaaaggtcgcgtcgggtaaatacacggccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggacgaggccttcgataacaacaacattcccgccctggtgggcgccctcagatacggtcagacagtggtcagccgcgacccgttcaaggctgtgacgtttgtagccaaccacgataccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcaccgacatagtctactacgataacgatgaactcatcttcgtcaggcacggctacggggacaagccggggcttataacctacatcaacctaggctcgagcaaggccggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctattgcggtgttgggtga

SEQ ID NO: 26 - protein, 436 aa, Artificial Sequence
  synthetically generated polypeptide
MAKYLELEEGGLIMQAFYWDVPMGGIWWDTIAQKIPDWASAGISAIWIPPASKGMSGGYSMGYDPYDYFDLGEYYQKGTVETRFGSKQELINMINTAHAYGMKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNNNIPALVGALRYGQTVVSRDPFKAVTFVANHDTDIIWNKYPAYAFILTYEGQPTIFYRDYEEWLNKDKLKNLIWIHDNLAGGSTDIVYYDNDELIFVRHGYGDKPGLITYINLGSSKAGRWVYVPKFAGSCIHEYTGNLGGWVDKWVDSSGWVYLEAPAHDPANGQYGYSVWSYCGVG

SEQ ID NO: 27 - DNA, 1311 bp, Artificial Sequence
  synthetically generated oligonucleotide
atggcaaagtattccgagctcgaagagggcggcgttataatgcaggccttctactgggacgtcccaggtggaggaatctggtgggacaccatcaggagcaagataccggagtggtacgaggcgggaatatccgccatttggattcctcccgcgagcaagggtatgagcggcggctattcgatgggctacgacccctacgattattttgacctcggtgagtactaccagaagggaacggtggaaacgaggttcggctcaaagcaggagctcataaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggacgcggcctttgacaacaagaacattcccgcactcgtcgaggccctcaagaacgggggcacagtcgtcagccgcgacccgtttaaggccgtaaccttcgttgcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcactgacatcgtttactacgacaacgacgagctgatattcgtgagaaacggctacggaagcaagccgggactgataacatacatcaacctcgcgtcaagcaaagccggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctactgcggtgttgggtga

SEQ ID NO: 28 - protein, 436 aa, Artificial Sequence
  synthetically generated polypeptide
MAKYSELEEGGVIMQAFYWDVPGGGIWWDTIRSKIPEWYEAGISAIWIPPASKGMSGGYSMGYDPYDYFDLGEYYQKGTVETRFGSKQELINMINTAHAYGIKVIADIVINHRAGGDLEWNPFVGDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDAAFDNKNIPALVEALKNGGTVVSRDPFKAVTFVANHDTDIIWNKYPAYAFILTYEGQPTIFYRDYEEWLNKDKLKNLIWIHDNLAGGSTDIVYYDNDELIFVRNGYGSKPGLITYINLASSKAGRWVYVPKFAGSCIHEYTGNLGGWVDKWVDSSGWVYLEAPAHDPANGQYGYSVWSYCGVG

SEQ ID NO: 29 - DNA, 1311 bp, Artificial Sequence
  synthetically generated oligonucleotide
atggccaagtacctggagctcgaagagggcgggctcataatgcaggccttctactgggacgtccccatgggaggaatctggtgggacacggtagcccagaagatacccgactgggcaagcgccgggatttcggcgatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacacggcccatgcctacggcataaaggtcatagcggacatcgtcataaaccaccgcgcaggcggagacctcgagtggaacccgttcgttggggactacacctggacggacttctcaaaggtggtctcgggcaaatatactgccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtaccttgcttatgccttcatcctcacctacgaaggccagcccgtcatattctaccgcgactacgaggagtggctcaacaaggacaggttgaacaacctcatatggatacacgaccacctcgcagggggaagcaccgacatagtctactacgataacgatgaactcatcttcgtcaggaacggctacggggacaagccggggcttataacctacatcaacctaggctcgagcaaggccggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctactgcggtgttgggtga

SEQ ID NO: 30 - protein, 436 aa, Artificial Sequence
  synthetically generated polypeptide
MAKYLELEEGGLIMQAFYWDVPMGGIWWDTVAQKIPDWASAGISAIWIPPASKGMGGAYSMGYDPYDFFDLGEYDQKGTVETRFGSKQELVNMINTAHAYGIKVIADIVINHRAGGDLEWNPFVGDYTWTDFSKVVSGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNKNIPALVSALQNGQTVVSRDPFKAVTFVANHDTDIIWNKYLAYAFILTYEGQPVIFYRDYEEWLNKDRLNNLIWIHDHLAGGSTDIVYYDNDELIFVRNGYGDKPGLITYINLGSSKAGRWVYVPKFAGACIHEYTGNLGGWVDKYVYSSGWVYLEAPAYDPANGQYGYSVWSYCGVG

SEQ ID NO: 31 - DNA, 1311 bp, Artificial Sequence
  synthetically generated oligonucleotide
atggcaaagtactccgagctggaagagggcggcgttataatgcaggccttctactgggacgtcccaggtggaggaatctggtgggacaccatcaggagcaggataccggagtggtacgaggcgggaatatccgccatttggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgctttgactacgtgaagggctacggagcgtgggtcgtcaaggactggctcaactggtggggcggctgggccgttggcgagtactgggacaccaacgttgatgcactcctcaactgggcctactcgagcggcgccaaggtcttcgacttcccgctctactacaagatggacgaggccttcgataacaacaacattcccgccctggtggacgccctcagatacggtcagacagtggtcagccgcgacccgttcaaggctgtgacgtttgtagccaaccacgataccgatataatctggaacaagtatccagcctacgcgttcatcctcacctacgagggccagccgacaatattctaccgcgactacgaggagtggctcaacaaggataagctcaagaacctcatctggatacatgacaacctggccggaggaagcacgagcatagtttactacgacagcgacgagatgatcttcgtgaggaccggctatggaagcaagcctggccttataacttacatcaacctcggctcgagcaaggttggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctattgcggtgttggctga

SEQ ID NO: 32 - protein, 436 aa, Artificial Sequence
  synthetically generated polypeptide
MAKYSELEEGGVIMQAFYWDVPGGGIWWDTIRSRIPEWYEAGISAIWIPPASKGMGGAYSMGYDPYDFFDLGEYDQKGTVETRFGSKQELVNMINTAHAYGIKVIADIVINHRAGGDLEWNPFVGDYTWTDFSKVASGKYTANYLDFHPNELHAGDSGTFGGYPDICHDKSWDQYWLWASQESYAAYLRSIGIDAWRFDYVKGYGAWVVKDWLNWWGGWAVGEYWDTNVDALLNWAYSSGAKVFDFPLYYKMDEAFDNNNIPALVDALRYGQTVVSRDPFKAVTFVANHDTDIIWNKYPAYAFILTYEGQPTIFYRDYEEWLNKDKLKNLIWIHDNLAGGSTSIVYYDSDEMIFVRTGYGSKPGLITYINLGSSKVGRWVYVPKFAGACIHEYTGNLGGWVDKYVYSSGWVYLEAPAYDPANGQYGYSVWSYCGVG

SEQ ID NO: 33 - DNA, 1311 bp, Artificial Sequence
  synthetically generated oligonucleotide
atggccaagtactccgagctggaagagggcggggtcataatgcaggcgttctactgggacgtgccttcaggaggaatatggtgggacacaatacggcagaagataccggagtggtacgatgccggaatctccgcaatatggattcctcccgcgagcaagggtatgagcggcggctattcgatgggctacgacccctacgattattttgacctcggtgagtactaccagaagggaacggtggaaacgaggttcggctcaaagcaggagctcataaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgctttgactacgtgaagggctacggagcgtgggtcgtcaaggactggctcaactggtggggcggctgggccgttggcgagtactgggacaccaacgttgatgcactcctcaactgggcctactcgagcggcgccaaggtcttcgactttccgctctactacaagatggacgcggcctttgacaacaagaacattcccgcactcgtcgaggccctcaagaacgggggcacagtcgtcagccgcgacccgtttaaggccgtaaccttcgttgcaaaccacgacaccgatataatctggaccaagtaccttgcttatgctttcatcctcacctacgaaggccagcccgtcatattctaccgcgactacgaggagtggctcaacaaggacaggttgaacaacctcatatggatacacgaccacctcgcaggtggaagcaccgacatagtctactacgataacgatgaactcatcttcgtcaggaacggctacggggacaagccggggcttataacctacatcaacctaggctcgagcaaggccggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctactgcggtgttggctga

SEQ ID NO: 34 - protein, 436 aa, Artificial Sequence
  synthetically generated polypeptide
MAKYSELEEGGVIMQAFYWDVPSGGIWWDTIRQKIPEWYDAGISAIWIPPASKGMSGGYSMGYDPYDYFDLGEYYQKGTVETRFGSKQELINMINTAHAYGIKVIADIVINHRAGGDLEWNPFVGDYTWTDFSKVASGKYTANYLDFHPNELHAGDSGTFGGYPDICHDKSWDQYWLWASQESYAAYLRSIGIDAWRFDYVKGYGAWVVKDWLNWWGGWAVGEYWDTNVDALLNWAYSSGAKVFDFPLYYKMDAAFDNKNIPALVEALKNGGTVVSRDPFKAVTFVANHDTDIIWTKYLAYAFILTYEGQPVIFYRDYEEWLNKDRLNNLIWIHDHLAGGSTDIVYYDNDELIFVRNGYGDKPGLITYINLGSSKAGRWVYVPKFAGSCIHEYTGNLGGWVDKWVDSSGWVYLEAPAHDPANGQYGYSVWSYCGVG

SEQ ID NO: 35 - DNA, 1311 bp, Artificial Sequence
  synthetically generated oligonucleotide
atggccaagtactccgagctggaagagggcggcgttataatgcaggccttctactgggacgtcccaggtggaggaatctggtgggacaccatcaggagcaagataccggagtggtacgaggcgggaatatccgccatttggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacaccgcccacgcctacggcatcaaggtcatcgcagacatagtaatcaaccaccgcgccggaggagaccttgagtggaaccccttcgtcaatgactacacctggacggacttctcgaaggtcgcttccggcaagtacacggccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggacgcggcctttgacaacaagaacattcccgcactcgtcgaggccctcaagaacgggggcacagtcgtcagccgcgacccgtttaaggccgtaaccttcgttgcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacgtcgccggaggaagcaccgacatagtctactacgataacgatgaactcatcttcgtcaggaacggctacggggacaagccggggcttataacctacatcaacctaggctcgagcaaggccggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctactgcggtgttgggtga

SEQ ID NO: 36 - protein, 436 aa, Artificial Sequence
  synthetically generated polypeptide
MAKYSELEEGGVIMQAFYWDVPGGGIWWDTIRSKIPEWYEAGISAIWIPPASKGMGGAYSMGYDPYDFFDLGEYDQKGTVETRFGSKQELVNMINTAHAYGIKVIADIVINHRAGGDLEWNPFVNDYTWTDFSKVASGKYTANYLDFHPNEVKCCDEGTFGGFPDIAHEKSWDQHWLWASDESYAAYLRSIGVDAWRFDYVKGYAPWVVKDWLNWWGGWAVGEYWDTNVDAVLNWAYSSGAKVFDFALYYKMDAAFDNKNIPALVEALKNGGTVVSRDPFKAVTFVANHDTDIIWNKYPAYAFILTYEGQPTIFYRDYEEWLNKDKLKNLIWIHDNVAGGSTDIVYYDNDELIFVRNGYGDKPGLITYINLGSSKAGRWVYVPKFAGSCIHEYTGNLGGWVDKWVDSSGWVYLEAPAHDPANGQYGYSVWSYCGVG

SEQ ID NO: 37 - DNA, 1311 bp, Artificial Sequence
  synthetically generated oligonucleotide
atggccaagtacctggagctcgaagagggcggggtcataatgcaggcgttctactgggacgtgccttcaggaggaatatggtgggacacaatacggcagaagataccggagtggtacgatgccggaatctccgcaatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacaccgcccacgcctatggcatgaaggtaatagccgatatagtcatcaaccaccgcgccggcggtgacctggagtggaaccccttcgtgaacgactatacctggaccgacttctcaaaggtcgcgtcgggtaaatacacggccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgctttgactacgtgaagggctacggagcgcgggtcgtcaaggactggctcaactggtggggcggctgggccgttggcgagtactgggacaccaacgttgatgcactcctcaactgggcctactcgagcggcgccaaggtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtatccagcctacgcgttcatcctcacctacgagggccagccgacaatattctatcgcgactacgaggagtggctcaacaaggataagctcaagaacctcatctggatacatgacaacctcgccggaggaagcactgacatcgtttactacgacaacgacgagctgatattcgtgagaaacggctacggaagcaagccgggactgataacatacatcaacctcgcctcaagcaaagccggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctactgcggggtggggtga

SEQ ID NO: 38 - protein, 436 aa, Artificial Sequence
  synthetically generated polypeptide
MAKYLELEEGGVIMQAFYWDVPSGGIWWDTIRQKIPEWYDAGISAIWIPPASKGMGGAYSMGYDPYDFFDLGEYDQKGTVETRFGSKQELVNMINTAHAYGMKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYGARVVKDWLNWWGGWAVGEYWDTNVDALLNWAYSSGAKVFDFPLYYKMDEAFDNKNIPALVSALQNGQTVVSRDPFKAVTFVANHDTDIIWNKYPAYAFILTYEGQPTIFYRDYEEWLNKDKLKNLIWIHDNLAGGSTDIVYYDNDELIFVRNGYGSKPGLITYINLASSKAGRWVYVPKFAGSCIHEYTGNLGGWVDKWVDSSGWVYLEAPAHDPANGQYGYSVWSYCGVG

SEQ ID NO: 39 - DNA, 1311 bp, Artificial Sequence
  synthetically generated oligonucleotide
atggccaagtacctggagctcgaagagggcggggtcataatgcaggcgttctactgggacgtgccttcaggaggaatatggtgggacacaatacggcagaagataccggagtggtacgatgccggaatctccgcaatatggattcctcccgcgagcaggggtatgagcggcggctattcgatgggctacgacccctacgattattttgacctcggtgagtactaccagaagggaacggtggaaacgaggttcggctcaaagcaggagctcataaacatgataaacaccgcccacgcctatggcatgaaggtaatagccgatatagtcatcaaccaccgcgccggcggtgacctggagtggaaccccttcgtgaacgactatacctggaccgacttctcaaaggtcgcgtcgggtaaatacacggccaactacctcgacttccacccgaacgagctccatgcgggcgattccggaacatttggaggctatcccgacatatgccacgacaagagctgggaccagtactggctctgggccagccaggagagctacgcggcatatctcaggagcatcggtatcgatgcctggcgctttgactacgtgaagggctacggagcgtgggtcgtcaaggactggctcaactggtggggcggctgggccgttggcgagtactgggaccccaacgttgatgccctcctcccctgggcctactcgagcggcgccaaggtcttcgacttcccgctctactacaagatggatgaggcctttgacaacaaaaacattccagcgctcgtctctgcccttcagaacggccagactgttgtctcccgcgacccgttcaaggccgtaacctttgtagccaaccacgataccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcaccgacatagtctactacgataacgatgaactcatcttcgtcaggaacggctacggggacaagccggggcttataacctacatcaacctaggctcgagcaaggccggaaggtgggtctacgttccgaagttcgcgggagcgtgcatccacgagtacaccggcaacctcggcggctgggtggacaagtgggtggactcaagcgggtgggtgtacctcgaggcccctgcccacgacccggccaacggctattacggctactccgtctggagctactgcggggtgggctga

SEQ ID NO: 40 - protein, 436 aa, Artificial Sequence
  synthetically generated polypeptide
MAKYLELEEGGVIMQAFYWDVPSGGIWWDTIRQKIPEWYDAGISAIWIPPASRGMSGGYSMGYDPYDYFDLGEYYQKGTVETRFGSKQELINMINTAHAYGMKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYGAWVVKDWLNWWGGWAVGEYWDPNVDALLPWAYSSGAKVFDFPLYYKMDEAFDNKNIPALVSALQNGQTVVSRDPFKAVTFVANHDTDIIWNKYPAYAFILTYEGQPTIFYRDYEEWLNKDKLKNLIWIHDNLAGGSTDIVYYDNDELIFVRNGYGDKPGLITYINLGSSKAGRWVYVPKFAGACIHEYTGNLGGWVDKWVDSSGWVYLEAPAHDPANGYYGYSVWSYCGVG

SEQ ID NO: 41 - DNA, 1311 bp, Artificial Sequence
  synthetically generated oligonucleotide
atggccaagtacctggagctcgaagagggcggggtcataatgcaggcgttctactgggacgtgccttcaggaggaatatggtgggacacaatacggcagaagataccggagtggtacgatgccggaatctccgcaatatggattcctcccgcgagcaagggtatgagcggcggctattcgatgggctacgacccctacgattattttgacctcggtgagtactaccagaagggaacggtggaaacgaggttcggctcaaagcaggagctcataaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgctttgactacgtgaagggctacggagcgtgggtcgtcaaggactggctcaactggtggggcggctgggccgttggcgagtactgggacaccaacgttgatgcactcctcaactgggcctactcgagcggcgccaaggtcttcgacttcccgctctactacaagatggacgcggcctttgacaacaagaacattcccgcactcgtcgaggccctcaagaacgggggcacagtcgtcagccgcgacccgtttaaggccgtaaccttcgttgcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcacgagcatagtttactacgacagcgacgagatgatcttcgtgaggaacggctatggaagcaagcctggccttataacttacatcaacctcggctcgagcaaggttggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctactgcggtgttgggtga

SEQ ID NO: 42 - protein, 436 aa, Artificial Sequence
  synthetically generated polypeptide
MAKYLELEEGGVIMQAFYWDVPSGGIWWDTIRQKIPEWYDAGISAIWIPPASKGMSGGYSMGYDPYDYFDLGEYYQKGTVETRFGSKQELINMINTAHAYGIKVIADIVINHRAGGDLEWNPFVGDYTWTDFSKVASGKYTANYLDFHPNELHAGDSGTFGGYPDICHDKSWDQYWLWASQESYAAYLRSIGIDAWRFDYVKGYGAWVVKDWLNWWGGWAVGEYWDTNVDALLNWAYSSGAKVFDFPLYYKMDAAFDNKNIPALVEALKNGGTVVSRDPFKAVTFVANHDTDIIWNKYPAYAFILTYEGQPTIFYRDYEEWLNKDKLKNLIWIHDNLAGGSTSIVYYDSDEMIFVRNGYGSKPGLITYINLGSSKVGRWVYVPKFAGACIHEYTGNLGGWVDKYVYSSGWVYLEAPAYDPANGQYGYSVWSYCGVG

SEQ ID NO: 43 - DNA, 1311 bp, Artificial Sequence
  synthetically generated oligonucleotide
atggccaagtactccgagctggaagagggcggcgttataatgcaggccttctactgggacgtcccaggtggaggaatctggtgggacaccatcaggagcaagataccggagtggtacgaggcgggaatatccgccatttggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgcttcgactacgtcaagggctacggagcgtgggtcgtcaaggactggctggactggtggggaggctgggccgtcggggagtactgggacacaaacgttgatgcactgctcaactgggcctactcgagcgatgcaaaagtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgtcggaggaagcacgagcatagtttactacgacagcgacgagatgatcttcgtgaggaacggctatggaagcaagcctggccttataacttacatcaacctcggctcgagcaaggttggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctactgcggtgttggctga

SEQ ID NO: 44 - protein, 436 aa, Artificial Sequence
  synthetically generated polypeptide
MAKYSELEEGGVIMQAFYWDVPGGGIWWDTIRSKIPEWYEAGISAIWIPPASKGMGGAYSMGYDPYDFFDLGEYDQKGTVETRFGSKQELVNMINTAHAYGIKVIADIVINHRAGGDLEWNPFVGDYTWTDFSKVASGKYTANYLDFHPNEVKCCDEGTFGGFPDIAHEKSWDQHWLWASDESYAAYLRSIGVDAWRFDYVKGYGAWVVKDWLDWWGGWAVGEYWDTNVDALLNWAYSSDAKVFDFPLYYKMDEAFDNKNIPALVSALQNGQTVVSRDPFKAVTFVANHDTDIIWNKYPAYAFILTYEGQPTIFYRDYEEWLNKDKLKNLIWIHDNLVGGSTSIVYYDSDEMIFVRNGYGSKPGLITYINLGSSKVGRWVYVPKFAGSCIHEYTGNLGGWVDKWVDSSGWVYLEAPAHDPANGQYGYSVWSYCGVG

SEQ ID NO: 45 - DNA, 1311 bp, Artificial Sequence
  synthetically generated oligonucleotide
atggccaagtactccgacctggaagagggcggcgttataatgcaggccttctactgggacgtcccaggtggaggaatctggtgggacaccatcaggagcaagataccggagtggtacgaggcgggaatatccgccatttggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgctttgactacgtgaagggctacggagcgtgggtcgtcaaggactggctcaactggtggggcggctgggccgttggcgagtactgggacaccaacgttgatgcactcctcaactgggcctactcgagcggcgccaaggtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcaccgacatagtctactacgataacgatgaactcatcttcgtcaggaacggctacggggacaagccggggcttataacctacatcaacctaggctcgagcaaggccggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctattgcggtgttgggtga

SEQ ID NO: 46 - protein, 436 aa, Artificial Sequence
  synthetically generated polypeptide
MAKYSDLEEGGVIMQAFYWDVPGGGIWWDTIRSKIPEWYEAGISAIWIPPASKGMGGAYSMGYDPYDFFDLGEYDQKGTVETRFGSKQELVNMINTAHAYGIKVIADIVINHRAGGDLEWNPFVGDYTWTDFSKVASGKYTANYLDFHPNEVKCCDEGTFGGFPDIAHEKSWDQHWLWASDESYAAYLRSIGVDAWRFDYVKGYGAWVVKDWLNWWGGWAVGEYWDTNVDALLNWAYSSGAKVFDFPLYYKMDEAFDNKNIPALVSALQNGQTVVSRDPFKAVTFVANHDTDIIWNKYPAYAFILTYEGQPTIFYRDYEEWLNKDKLKNLIWIHDNLAGGSTDIVYYDNDELIFVRNGYGDKPGLITYINLGSSKAGRWVYVPKFAGACIHEYTGNLGGWVDKYVYSSGWVYLEAPAYDPANGQYGYSVWSYCGVG

SEQ ID NO: 47 - DNA, 1311 bp, Artificial Sequence
  synthetically generated oligonucleotide
atggccaagtacaccgagctggaagagggcggcgttataatgcaggccttctactgggacgtcccaggtggaggaatctggtgggacaccatcaggagcaagataccggagtggtacgaggcgggaatatccgccatttggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacaccgcccacgcctatggcatgaaggtaatagccgatatagtcatcaaccaccgcgccggcggtgacctggagtggaaccccttcgtgaacgactatacctggaccgacttctcaaaggtcgcgtcgggtaaatacacggccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgctttgactacgtgaagggctacggagcgtgggtcgtcaaggactggctcaactggtggggcggttgggccgttggcgagtactgggacaccaacgttgatgcactcctcaactgggcctactcgagcggcgccaaggtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtaccttgcttatgctttcatcctcacctacgaaggccagcccgtcatattctaccgcgactacgaggagtggctcaacaaggacaggttgaacaacctcatatggatacacgaccacctcgcaggtggaagcacgagcatagtttactacgacagcgacgagatgatcttcgtgaggaacggctatggaagcaagcctggccttataacttacatcaacctcggctcgagcaaggttggaaggtgggtttacgttccgaagttcgcaggcccgtgcatacacgagtacaccggcaatctcggcggctgggtggacaagtgggtggactcaagcggctgggtctacctcgaggctcctgcccacgacccggccaacggccagtacggctactccgtctggagctactgcggtgttgggtag

SEQ ID NO: 48 - protein, 436 aa, Artificial Sequence
  synthetically generated polypeptide
MAKYTELEEGGVIMQAFYWDVPGGGIWWDTIRSKIPEWYEAGISAIWIPPASKGMGGAYSMGYDPYDFFDLGEYDQKGTVETRFGSKQELVNMINTAHAYGMKVIADIVINHRAGGDLEWNPFVNDYTWTDFSKVASGKYTANYLDFHPNEVKCCDEGTFGGFPDIAHEKSWDQHWLWASDESYAAYLRSIGVDAWRFDYVKGYGAWVVKDWLNWWGGWAVGEYWDTNVDALLNWAYSSGAKVFDFPLYYKMDEAFDNKNIPALVSALQNGQTVVSRDPFKAVTFVANHDTDIIWNKYLAYAFILTYEGQPVIFYRDYEEWLNKDRLNNLIWIHDHLAGGSTSIVYYDSDEMIFVRNGYGSKPGLITYINLGSSKVGRWVYVPKFAGPCIHEYTGNLGGWVDKWVDSSGWVYLEAPAHDPANGQYGYSVWSYCGVG

SEQ ID NO: 49 - DNA, 387 bp, Artificial Sequence
  synthetically generated oligonucleotide
gtggtttatgacgatgtccgctatgacctttatgccgtaggcatgggccgtgtttatcatgttcacgagctcctgcttggagccaaagcgcgtctctaccgttcccttctggtcgtactcaccgaggtcaaagaagtcgtaggggtcgtagcccatcgaataggcgccgcccatgcccttgctcgccgggggaatccatatcgccgaaatcccggcgcttgcccagtcgggtatcttctgggctatcgtgtcccaccagattcctcccatggggacgtcccagtagaaggcctgcattatgagcccgccctcttcgagcccggaatactttgccataagttacctcctactagtagattaaaattctgtttcctgtgtgaaattgtt

SEQ ID NO: 50 - protein, 129 aa, Artificial Sequence
  synthetically generated polypeptide
VVYDDVRYDLYAVGMGRVYHVHELLLGAKARLYRSLLVVLTEVKEVVGVVAHRIGAAHALARRGNPYRRNPGACPVGYLLGYRVPPDSSHGDVPVEGLHYEPALFEPGILCHKLPPTSRLKFCFLCEIV

SEQ ID NO: 51 - DNA, 1311 bp, Artificial Sequence
  synthetically generated oligonucleotide
atggccaagtacctggagctcgaagagggcggggtcataatgcaggcgttctactgggacgtgccttcaggaggaatatggtgggacacaatacggcagaagataccggagtggtacgatgccggaatctccgcaatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacaccgcccacgcctatggcatgaaggtaatagccgatatagtcatcaaccaccgcgccggcggtgacctggagtggaaccccttcgtgaacgactatacctggaccgacttctcaaaggtcgcgtcgggtaaatacacggccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgctttgactacgtgaagggctacggagcgtgggtcgtcaaggactggctcaactggtggggcggctgggccgttggcgagtactgggacaccaacgttgatgcactcctcaactgggcctactcgagcggcgccaaggtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcactgacatcgtttactacgacaacgacgagctgatattcgtgagaaacggctacggaagcaagccgggactgataacatacatcaacctcgcctcaagcaaagccggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctattgcggtgttggctga

SEQ ID NO: 52 - protein, 436 aa, Artificial Sequence
  synthetically generated polypeptide
MAKYLELEEGGVIMQAFYWDVPSGGIWWDTIRQKIPEWYDAGISAIWIPPASKGMGGAYSMGYDPYDFFDLGEYDQKGTVETRFGSKQELVNMINTAHAYGMKVIADIVINHRAGGDLEWNPFVNDYTWTDFSKVASGKYTANYLDFHPNEVKCCDEGTFGGFPDIAHEKSWDQHWLWASDESYAAYLRSIGVDAWRFDYVKGYGAWVVKDWLNWWGGWAVGEYWDTNVDALLNWAYSSGAKVFDFPLYYKMDEAFDNKNIPALVSALQNGQTVVSRDPFKAVTFVANHDTDIIWNKYPAYAFILTYEGQPTIFYRDYEEWLNKDKLKNLIWIHDNLAGGSTDIVYYDNDELIFVRNGYGSKPGLITYINLASSKAGRWVYVPKFAGSCIHEYTGNLGGWVDKWVDSSGWVYLEAPAHDPANGQYGYSVWSYCGVG

SEQ ID NO: 53 - DNA, 1311 bp, Artificial Sequence
  synthetically generated oligonucleotide
atggccaagtactccgagctggaagagggcggcgttataatgcaggccttctactgggacgtcccaggtggaggaatctggtgggacaccatcaggagcaagataccggagtggtacgaggcgggaatatccgccatttggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacacggcccatgcctacggcataaaggtcatagcggacatcgtcataaaccaccgcacaggcggagacctcgagtggaacccgttcgttggggactacacctggacggacttctcaaaggtggcctcgggcaaatatactgccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgcttcgactacgtcaagggctacggagcgtgggtcgtcaaggactggctggactggtggggaggctgggccgtcggggagtactgggacacaaacgttgatgcactgctcaactgggcctactcgagcgatgcaaaagtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcactgacatcgtttactacgacaacgacgagctgatattcgtgagaaacggctacggaagcaagccgggactgataacatacatcaacctcgcctcaagcaaagccggaaggtgggtctacgttccgaagttcgcgggagcgtgcatccacgagtacaccggcaacctcggcggctgggtggacaagtgggtggactcaagcgggtgggtgtacctcgaggcccctgcccacgacccggccaacggctattacggctactccgtctggagctactgcggtgttggctga

SEQ ID NO: 54 - protein, 436 aa, Artificial Sequence
  synthetically generated polypeptide
MAKYSELEEGGVIMQAFYWDVPGGGIWWDTIRSKIPEWYEAGISAIWIPPASKGMGGAYSMGYDPYDFFDLGEYDQKGTVETRFGSKQELVNMINTAHAYGIKVIADIVINHRTGGDLEWNPFVGDYTWTDFSKVASGKYTANYLDFHPNEVKCCDEGTFGGFPDIAHEKSWDQHWLWASDESYAAYLRSIGVDAWRFDYVKGYGAWVVKDWLDWWGGWAVGEYWDTNVDALLNWAYSSDAKVFDFPLYYKMDEAFDNKNIPALVSALQNGQTVVSRDPFKAVTFVANHDTDIIWNKYPAYAFILTYEGQPTIFYRDYEEWLNKDKLKNLIWIHDNLAGGSTDIVYYDNDELIFVRNGYGSKPGLITYINLASSKAGRWVYVPKFAGACIHEYTGNLGGWVDKWVDSSGWVYLEAPAHDPANGYYGYSVWSYCGVG

SEQ ID NO: 55 - DNA, 1311 bp, Artificial Sequence
  synthetically generated oligonucleotide
atggccaagtacctggagctcgaggagggcggggtcataatgcaggcgttctactgggacgtgccttcaggaggaatatggtgggacacaatacggcagaagataccggagtggtacgatgccggaatctccgcaatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacaccgcccacgcctatggcatgaaggtaatagccgatatagtcatcaaccaccgcgccggcggtgacctggagtggaaccccttcgtgaacgactatacctggaccgacttctcaaaggtcgcgtcgggtaaatacacggccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgctttgactacgtgaagggctacggagcgtgggtcgtcaaggactggctcaactggtggggcggctgggccgttggcgagtactgggacaccaacgttgatgcactcctcaactgggcctactcgagcggcgccaaggtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtaccttgcttatgctttcatcctcacctacgaaggccagcccgtcatattctaccgcgactacgaggagtggctcaacaaggacaggttgaacaacctcatatggatacacgaccacctcgcaggtggaagcacgagcatagtttactacgacagcgacgagatgatcttcgtgaggaacggctatggaagcaagcctggccttataacttacatcaacctcggctcgagcaaggttggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctattgcggtgttggctga

SEQ ID NO: 56 - protein, 436 aa, Artificial Sequence
  synthetically generated polypeptide
MAKYLELEEGGVIMQAFYWDVPSGGIWWDTIRQKIPEWYDAGISAIWIPPASKGMGGAYSMGYDPYDFFDLGEYDQKGTVETRFGSKQELVNMINTAHAYGMKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYGAWVVKDWLNWWGGWAVGEYWDTNVDALLNWAYSSGAKVFDFPLYYKMDEAFDNKNIPALVSALQNGQTVVSRDPFKAVTFVANHDTDIIWNKYLAYAFILTYEGQPVIFYRDYEEWLNKDRLNNLIWIHDHLAGGSTSIVYYDSDEMIFVRNGYGSKPGLITYINLGSSKVGRWVYVPKFAGSCIHEYTGNLGGWVDKWVDSSGWVYLEAPAHDPANGQYGYSVWSYCGVG

SEQ ID NO: 57 - DNA, 1311 bp, Artificial Sequence
  synthetically generated oligonucleotide
atggccaagtacctggagctcgaagagagcggggtcataatgcaggcgttctactgggacgtgccttcaggaggaatatggtgggacacaatacggcagaagataccggagtggtacgatgccggaatctccgcaatatggattcctcccgcgagcaagggtatgagcggcggctattcgatgggctacgacccctacgattattttgacctcggtgagtactaccagaagggaacggtggaaacgaggttcggctcaaagcaggagctcataaacatgataaacaccgcccacgcctacggcatcaaggtcatcgcagacatagtaatcaaccaccgcgccggaggagaccttgagtggaaccccttcgtcaatgactacacctggacggacttctcgaaggtcgcttccggcaagtacacggccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgctttgactacgtgaagggctacggagcgtgggtcgtcaaggactggctcaactggtggggtggctgggccgtcggggagtactgggacacaaacgttgatgcactgctcaactgggcctactcgagcgatgcaaaagtcttcgacttcccgctctactacaagatggacgaggccttcgataacaacaacattcccgccctggtggacgccctcagatacggtcagacagtggtcagccgcgacccgttcaaggctgtgacgtttgtagccaaccacgataccgatataatctggaacaagtaccttgcttatgctttcatcctcacctacgaaggccagcccgtcatattctaccgcgactacgaggagtggctcaacaaggacaggttgaacaacctcatatggatacacgaccacctcgcaggtggaagcactgacatcgtttactacgacaacgacgagctgatattcgtgagaaacggctacggaagcaagccgggactgataacatacatcaacctcgcctcaagcaaagccggaaggtgggtctacgttccgaagttcgcgggagcgtgcatccacgagtacaccggcaacctcggcggctgggtggacaagtgggtggactcaagcgggtgggtgtacctcgaggcccctgcccacgacccggccaacggctattacggctactccgtctggagctattgcggtgttggctga

SEQ ID NO: 58 - protein, 436 aa, Artificial Sequence
  synthetically generated polypeptide
MAKYLELEESGVIMQAFYWDVPSGGIWWDTIRQKIPEWYDAGISAIWIPPASKGMSGGYSMGYDPYDYFDLGEYYQKGTVETRFGSKQELINMINTAHAYGIKVIADIVINHRAGGDLEWNPFVNDYTWTDFSKVASGKYTANYLDFHPNEVKCCDEGTFGGFPDIAHEKSWDQHWLWASDESYAAYLRSIGVDAWRFDYVKGYGAWVVKDWLNWWGGWAVGEYWDTNVDALLNWAYSSDAKVFDFPLYYKMDEAFDNNNIPALVDALRYGQTVVSRDPFKAVTFVANHDTDIIWNKYLAYAFILTYEGQPVIFYRDYEEWLNKDRLNNLIWIHDHLAGGSTDIVYYDNDELIFVRNGYGSKPGLITYINLASSKAGRWVYVPKFAGACIHEYTGNLGGWVDKWVDSSGWVYLEAPAHDPANGYYGYSVWSYCGVG

SEQ ID NO: 59 - DNA, 1311 bp, Artificial Sequence
  synthetically generated oligonucleotide
atggccaagtacctggagctcgaagagggcggggtcataatgcaggcgttctactgggacgtgccttcaggaggaatatggtgggacacaatacggcagaagataccggagtggtacgatgccggaatctccgcaatatggattcctcccgcgagcaagggtatgagcggcggctattcgatgggctacgacccctacgattattttgacctcggtgagtactaccagaagggaacggtggaaacgaggttcggctcaaagcaggagctcataaacatgataaacaccgcccacgcctacggcatcaaggtcatcgcagacatagtaatcaaccaccgcgccggaggagaccttgagtggaaccccttcgtcaatgactacacctggacggacttctcgaaggtcgcttccggcaagtacacggccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggacgaggccttcgataacaacaacattcccgccctggtggacgccctcagatacggtcagacagtggtcagccgcgacccgttcaaggctgtgacgtttgtagccaaccacgataccgatataatttggaacaagtacccggcctacgccttcatcctcacctacgagggccagccgacgatattctaccgcgactacgaggagtggctcaacaaggacaggctcaagaacctcatctggatacacgaccacctcgccggtggaagcactgacatcgtttactacgacaacgacgagctgatattcgtgagaaacggctacggaagcaagccgggactgataacatacatcaacctcgcgtcaagcaaagccggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctattgcggtgttgggtga

SEQ ID NO: 60 - protein, 436 aa, Artificial Sequence
  synthetically generated polypeptide
MAKYLELEEGGVIMQAFYWDVPSGGIWWDTIRQKIPEWYDAGISAIWIPPASKGMSGGYSMGYDPYDYFDLGEYYQKGTVETRFGSKQELINMINTAHAYGIKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNNNIPALVDALRYGQTVVSRDPFKAVTFVANHDTDIIWNKYPAYAFILTYEGQPTIFYRDYEEWLNKDRLKNLIWIHDHLAGGSTDIVYYDNDELIFVRNGYGSKPGLITYINLASSKAGRWVYVPKFAGACIHEYTGNLGGWVDKYVYSSGWVYLEAPAYDPANGQYGYSVWSYCGVG

SEQ ID NO: 61 - DNA, 1311 bp, Artificial Sequence
  synthetically generated oligonucleotide
atggccaagtactccgagctgaaaaagggcggggtcataatgcaggcgttctactgggacgtgccttcaggaggaatatggtgggacacaatacggcagaagataccggagtggtacgaggcgggaatatccgccatttggattcctcccgcgagcaagggtatgagcggcggctattcgatgggctacgacccctacgattattttgacctcggtgagtactaccagaagggaacggtggaaacgaggttcggctcaaagcaggagctcataaacatgataaacaccgcccacgcctacggcatcaaggtcatcgcagacatagtaatcaaccaccgcgccggaggagaccttgagtggaaccccttcgtcaatgactacacctggacggacttctcgaaggtcgcttccggcaagtacacggccaactacctcaacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctacggagcgtgggtcgtcaaggactggctggactggtggggaggctgggccgtcggggagtactgggacacaaacgttgatgcactgctcaactgggcctactcgagcgatgcaaaagtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccatgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcaccgacatagtctactacgataacgatgaactcatcttcgtcaggaacggctacggggacaagccggggcttataacctacatcaacctaggctcgagcaaggccggaaggtgggtctacgttccgaagttcgcgggagcgtgcatccacgagtacaccggcaacctcggcggctgggtggacaagtgggtggactcaagcgggtgggtgtacctcgaggcccctgcccacgacccggccaacggctattacggctactccgtctggagctactgcggggtgggctga

SEQ ID NO: 62 - protein, 436 aa, Artificial Sequence
  synthetically generated polypeptide
MAKYSELKKGGVIMQAFYWDVPSGGIWWDTIRQKIPEWYEAGISAIWIPPASKGMSGGYSMGYDPYDYFDLGEYYQKGTVETRFGSKQELINMINTAHAYGIKVIADIVINHRAGGDLEWNPFVNDYTWTDFSKVASGKYTANYLNFHPNELHAGDSGTFGGYPDICHDKSWDQYWLWASQESYAAYLRSIGIDAWRFDYVKGYGAWVVKDWLDWWGGWAVGEYWDTNVDALLNWAYSSDAKVFDFPLYYKMDEAFDNKNIPALVSALQNGQTVVSRDPFKAVTFVANHDTDIIWNKYPAYAFILTYEGQPTIFYRDYEEWLNKDKLKNLIWIHDNLAGGSTDIVYYDNDELIFVRNGYGDKPGLITYINLGSSKAGRWVYVPKFAGACIHEYTGNLGGWVDKWVDSSGWVYLEAPAHDPANGYYGYSVWSYCGVG

SEQ ID NO: 63 - DNA, 1311 bp, Artificial Sequence
  synthetically generated oligonucleotide
atggccaagtacctggagctcgaagagggcggggtcataatgcaggcgttctactgggacgtgccttcaggaggaatatggtgggacacaatacggcagaagataccggagtggtacgatgccggaatctccgcaatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacacggcccatgcctacggcataaaggccatagcggacatcgtcataaaccaccgcgcaggcggagacctcgagtggaacccgttcgttggggactacacctggacggacttctcaaaggtggcctcgggcaaatatactgccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgctttgactacgtgaagggctacggagcgtgggtcgtcaaggactggctcaactggtggggcggctgggccgttggcgagtactgggacaccaacgttgatgcactcctcaactgggcctactcgagcggcgccaaggtcttcgacttcccgctctactacaagatggacgcggcctttgacaacaagaacattcccgcactcgtcgaggccctcaagaacgggggcacagtcgtcagccgcgacccgtttaaggccgtaaccttcgttgcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcaccgacatagtctactacgataacgatgaactcatcttcgtcaggaacggctacggggacaagccggggcttataacctacatcaacctaggctggagcaaggccggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctactgcggggtggggtga

SEQ ID NO: 64 - protein, 436 aa, Artificial Sequence
  synthetically generated polypeptide
MAKYLELEEGGVIMQAFYWDVPSGGIWWDTIRQKIPEWYDAGISAIWIPPASKGMGGAYSMGYDPYDFFDLGEYDQKGTVETRFGSKQELVNMINTAHAYGIKAIADIVINHRAGGDLEWNPFVGDYTWTDFSKVASGKYTANYLDFHPNEVKCCDEGTFGGFPDIAHEKSWDQHWLWASDESYAAYLRSIGVDAWRFDYVKGYGAWVVKDWLNWWGGWAVGEYWDTNVDALLNWAYSSGAKVFDFPLYYKMDAAFDNKNIPALVEALKNGGTVVSRDPFKAVTFVANHDTDIIWNKYPAYAFILTYEGQPTIFYRDYEEWLNKDKLKNLIWIHDNLAGGSTDIVYYDNDELIFVRNGYGDKPGLITYINLGWSKAGRWVYVPKFAGACIHEYTGNLGGWVDKYVYSSGWVYLEAPAYDPANGQYGYSVWSYCGVG

SEQ ID NO: 65 - DNA, 1311 bp, Artificial Sequence
  synthetically generated oligonucleotide
atggccaagtactccgagctggaagaaggcggcgttataatgcaggccttctactgggacgtcccaggtggaggaatctggtggggcaccatcaggagcaagataccggagtggtacgaggcgggaatatccgccatttggattcctcccgcgagcaagggtatgagcggcggctattcgatgggctacgacccctacgattattttgacctcggtgagtactaccagaagggaacggtggaaacgaggttcggctcaaagcaggagctcataaacatgataaacaccgcccacgcctatggcatgaaggtaatagccgatatagtcatcaaccaccgcgccggcggtgacctggagtggaaccccttcgtgaacgactatacctggaccgacttctcaaaggtcgcgtcgggtaaatacacggccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggacgaggccttcgataacaacaacattcccgccctggtggacgccctcagatacggtcagacagtggtcagccgcgacccgttcaaggctgtgacgtttgtagccaaccacgataccgatataatttggaacaagtacccggcctacgccttcatcctcacctacgagggccagccgacgatattctaccgcgactacgaggagtggctcaacaaggacaggctcaagaacctcatctggatacacgaccacctcgccggtggaagcacgagcatagtttactacgacagcgacgagatgatcttcgtgaggaacggctatggaagcaagcctggccttataacttacatcaacctcggctcgagcaaggttggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctattgcggtgttggctga

SEQ ID NO: 66 - protein, 436 aa, Artificial Sequence
  synthetically generated polypeptide
MAKYSELEEGGVIMQAFYWDVPGGGIWWGTIRSKIPEWYEAGISAIWIPPASKGMSGGYSMGYDPYDYFDLGEYYQKGTVETRFGSKQELINMINTAHAYGMKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNNNIPALVDALRYGQTVVSRDPFKAVTFVANHDTDIIWNKYPAYAFILTYEGQPTIFYRDYEEWLNKDRLKNLIWIHDHLAGGSTSIVYYDSDEMIFVRNGYGSKPGLITYINLGSSKVGRWVYVPKFAGSCIHEYTGNLGGWVDKWVDSSGWVYLEAPAHDPANGQYGYSVWSYCGVG

SEQ ID NO: 67 - DNA, 1311 bp, Artificial Sequence
  synthetically generated oligonucleotide
atggccaagtacctggagctcgaagagggcggggtcataatgcaggcgttctactgggacgtgccttcgggaggaatatggtgggacacaatacggcagaagataccggagtggtacgatgccggaatctccgcaatatggattcctcccgcgagcaagggtatgagcggcggctattcgatgggctacgacccctacgattattttgacctcggtgagtactaccagaagggaacggtggaaacgaggttcggctcaaagcaggagctcataaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgcttcgactacgtcaagggctacggagcgtgggtcgtcaaggactggctggactggtggggaggctgggccgtcggggagtactgggacacaaacgttgatgcactgctcaactgggcctactcgagcgatgcaaaagtcttcgacttcccgctctactacaagatggacgaggccttcgataacaacaacattcccgccctggtggacgccctcagatacggtcagacagtggtcagccgcgacccgttcaaggctgtgacgtttgtagccaaccacgataccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcacgagcatagtttactacgacagcgacgagatgatcttcgtgaggaacggctatggaagcaagcctggccttataacttacatcaacctcggctcgagcaaggttggaaggtgggtctacgttccgaagttcgcgggagcgtgcatccacgagtacaccggcaacctcggcggctgggtggacaagtgggtggactcaagcgggtgggtgtacctcgaggcccctgcccacgacccggccaacggctattacggctactccgtctggagctactgcgtggtgggctga

SEQ ID NO: 68 - protein, 436 aa, Artificial Sequence
  synthetically generated polypeptide
MAKYLELEEGGVIMQAFYWDVPSGGIWWDTIRQKIPEWYDAGISAIWIPPASKGMSGGYSMGYDPYDYFDLGEYYQKGTVETRFGSKQELINMINTAHAYGIKVIADIVINHRAGGDLEWNPFVGDYTWTDFSKVASGKYTANYLDFHPNEVKCCDEGTFGGFPDIAHEKSWDQHWLWASDESYAAYLRSIGVDAWRFDYVKGYGAWVVKDWLDWWGGWAVGEYWDTNVDALLNWAYSSDAKVFDFPLYYKMDEAFDNNNIPALVDALRYGQTVVSRDPFKAVTFVANHDTDIIWNKYPAYAFILTYEGQPTIFYRDYEEWLNKDKLKNLIWIHDNLAGGSTSIVYYDSDEMIFVRNGYGSKPGLITYINLGSSKVGRWVYVPKFAGACIHEYTGNLGGWVDKWVDSSGWVYLEAPAHDPANGYYGYSVWSYCVVG

SEQ ID NO: 69 - DNA, 1542 bp, Environmental
atgttgaaaaggattacggtagtctgtttattgtttattttgctttttcctaatatatatgagggaaataaggcagaagcagcaacagtgaacaatggaacattaatgcagtattttgagtggtacgctccgaatgatgggaatcattggaatcgtttgcgttccgatgctgaaagtttagctcataaaggaatcacatctgtatggataccacctgcatataaagggacttcgcaaaatgatgtagggtatggggcctatgatttatatgatttaggggagttcaatcaaaaaggaacggtgcggacgaaatatgggacaaaagcacagttgaaatctgcaattgacgctttacataagcaaaacatcgacgtatacggtgatgtagttatgaatcataaaggtggggctgattatactgaaaccgtaacagctgttgaggtagaccgtaacaatcgaaatattgaagtatcaggtgattatcaaattagtgcatggacggggtttaattttccagggcgcggagatgcttattctaatttcaaatggaaatggtatcattttgacggaacggattgggatgaaggaaggaaattaaatcgaatttataaatttaggggtgtagataaagcgtgggattgggaagtgtctagcgaaaatggaaattatgattatttgatgtatgcagatcttgattttgatcatcctgatgttgcgaatgagatgaaaaattggggaacatggtatgcgaatgaattaaatttagatggctttcgtttggacgctgttaaacatattgatcatgaatatttacgcgattgggtaaatcatgccagacagcaaacggggaaagaaatgtttacagtagctgaatattggcaaaatgatgttcaggctttaaacaattatttagcgaaagtcaattataatcaatctgtgtttgatgcaccgcttcattacaattttcattatgcttcaacaggaaatgggaattatgatatgagaaatattttaaatggaacagtaatgaaaaatcaccctgcactcgcagttactctcgttgagaatcatgattctcagcctgggcagtcattggaatctgtagtaagtccgtggtttaagccgctggcatatgcatttattttaactcgtgcagagggctatccttcagttttctatggtgattactatgggacaagcggaaatagtagttatgaaattccagcgttaaaagataaaattgatccaattttgacggcacgaaaaaactttgcatatggtacgcagcgtgattatttagaccatccagatgtgattggctggacaagagaaggcgatggtgtacatgctaattctggtttagcgacattactctcggacggaccaggaggatcaaagtggatggatgttggaaagaataacgctggggaagtatggtacgatattacgggtaatcaaacaaatactgtaacaattaataaggacggatgggggcagttctatgtaagtggcggctcagtttccatatatgttcagcggtaa

SEQ ID NO: 70 - protein, 513 aa, Environmental
MLKRITVVCLLFILLFPNIYEGNKAEAATVNNGTLMQYFEWYAPNDGNHWNRLRSDAESLAHKGITSVWIPPAYKGTSQNDVGYGAYDLYDLGEFNQKGTVRTKYGTKAQLKSAIDALHKQNIDVYGDVVMNHKGGADYTETVTAVEVDRNNRNIEVSGDYQISAWTGFNFPGRGDAYSNFKWKWYHFDGTDWDEGRKLNRIYKFRGVDKAWDWEVSSENGNYDYLMYADLDFDHPDVANEMKNWGTWYANELNLDGFRLDAVKHIDHEYLRDWVNHARQQTGKEMFTVAEYWQNDVQALNNYLAKVNYNQSVFDAPLHYNFHYASTGNGNYDMRNILNGTVMKNHPALAVTLVENHDSQPGQSLESVVSPWFKPLAYAFILTRAEGYPSVFYGDYYGTSGNSSYEIPALKDKIDPILTARKNFAYGTQRDYLDHPDVIGWTREGDGVHANSGLATLLSDGPGGSKWMDVGKNNAGEVWYDITGNQTNTVTINKDGWGQFYVSGGSVSIYVQR

SEQ ID NO: 71 - DNA, 1311 bp, Artificial Sequence
  synthetically generated oligonucleotide
atggccaagtacctggagctcgaagagggcggggtcataatgcaggcgttctactgggacgtgccttcaggaggaatatggtgggacacaatacggcagaagataccggagtggtacgatgccggaatctccgcaatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacacggcccatgcctacggcataaaggtcatagcggacatcgtcataaaccaccgcgcaggcggagacctcgagtggaacccgttcgttggggactacacctggacggacttctcaaaggtagcctcgggcaaatatactgccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcactgacatcgtttactacgacaacgacgagctgatattcgtgagaaacggctacggaagcaagccgggactgataacatacatcaacctcgcctcaagcaaagccggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctactgcggggtgggctga

SEQ ID NO: 72 - protein, 436 aa, Artificial Sequence
  synthetically generated polypeptide
MAKYLELEEGGVIMQAFYWDVPSGGIWWDTIRQKIPEWYDAGISAIWIPPASKGMGGAYSMGYDPYDFFDLGEYDQKGTVETRFGSKQELVNMINTAHAYGIKVIADIVINHRAGGDLEWNPFVGDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNKNIPALVSALQNGQTVVSRDPFKAVTFVANHDTDIIWNKYPAYAFILTYEGQPTIFYRDYEEWLNKDKLKNLIWIHDNLAGGSTDIVYYDNDELIFVRNGYGSKPGLITYINLASSKAGRWVYVPKFAGACIHEYTGNLGGWVDKYVYSSGWVYLEAPAYDPANGQYGYSVWSYCGVG

SEQ ID NO: 73 - DNA, 1299 bp, Environmental
atggctctggaagagggcgggcttataatgcaggccttctactgggacgtcccaggtggaggaatctggtgggacaccatagcccagaagatacccgactgggcgagcgccgggatttcggcaatatggattcctcccgcgagtaagggcatgagcggcggctattcgatgggctacgacccctacgatttcttcgacctcggtgagtactaccagaagggaagcgttgagacccgcttcggatcaaaagaggagcttgtgaacatgataaacaccgcccatgctcacaacatgaaggtcatagcggacatagtcatcaaccaccgcgccggcggcgacctggagtggaatcctttcaccaacagctacacctggaccgatttctcgaaggtcgcgtcgggcaagtacacggccaactacctcgacttccacccgaacgagcttcacgcgggcgattccggaacatttggaggctatcccgacatatgccacgacaagagctgggaccagcactggctctgggccagcaacgaaagctacgccgcctacctccggagcatcggcatcgacgcctggcgcttcgactacgtcaagggctacgctccctgggtcgttaagaactggctgaaccggtggggcggctgggcggttggagagtactgggacaccaacgtcgatgcactcctgagctgggcctacgacagcggtgctaaagtcttcgacttcccgctctactacaagatggacgaggccttcgataacaacaacatccccgccctcgtggacgccctcaagaacggaggcacggtcgtcagccgcgacccgttcaaagccgtgaccttcgttgccaaccacgataccaacataatctggaacaagtatccggcctacgccttcatcctcacctatgagggacagccggcaatattctaccgcgactacgaggagtggctcaacaaggacaggctcaggaacctcatctggatacacgaccacctcgcgggaggaagcacagacatcatctactacgacagcgacgagcttatcttcgtgagaaacggctacggggacaagccgggactgataacctacatcaacctcggctcaagcaaggccggaaggtgggtctacgttccgaagttcgcaggctcgtgcatacacgagtacaccggcaacctcggcggctggattgacaagtgggttgactcaagcggtcgggtctaccttgaggcccccgcccacgacccggccaacggccagtacggctactccgtatggagctactgcggtgttgggtga

SEQ ID NO: 74 - protein, 432 aa, Environmental
MALEEGGLIMQAFYWDVPGGGIWWDTIAQKIPDWASAGISAIWIPPASKGMSGGYSMGYDPYDFFDLGEYYQKGSVETRFGSKEELVNMINTAHAHNMKVIADIVINHRAGGDLEWNPFTNSYTWTDFSKVASGKYTANYLDFHPNELHAGDSGTFGGYPDICHDKSWDQHWLWASNESYAAYLRSIGIDAWRFDYVKGYAPWVVKNWLNRWGGWAVGEYWDTNVDALLSWAYDSGAKVFDFPLYYKMDEAFDNNNIPALVDALKNGGTVVSRDPFKAVTFVANHDTNIIWNKYPAYAFILTYEGQPAIFYRDYEEWLNKDRLRNLIWIHDHLAGGSTDIIYYDSDELIFVRNGYGDKPGLITYINLGSSKAGRWVYVPKFAGSCIHEYTGNLGGWIDKWVDSSGRVYLEAPAHDPANGQYGYSVWSYCGVG

SEQ ID NO: 75 - DNA, 1299 bp, Environmental
atggctctggaagagggcgggcttataatgcaggcattctactgggacgtccccatgggaggaatctggtgggacacgatagcccagaagatacccgactgggcaagcgccgggatttcggcgatatggattccccccgcgagcaagggtatgagcggcggctattcgatgggctacgacccctacgattattttgacctcggtgagtactaccagaagggaacggtggaaacaagattcggctcaaagcaggagctcataaacatgataaacaccgcccacgcctatggcatgaaggtaatagccgatatagtcatcaaccaccgcgccggcggcgatctggagtggaaccccttcgtgaacgactatacctggaccgacttctcgaaggtcgcgtcgggtaaatacacggccaactacctcgacttccacccgaacgagctccacgcgggcgattccggaacatttggaggctatcccgacatatgccacgacaagagctgggaccagtactggctctgggccagccaggagagctacgcggcctatctcaggagcatcggcatcgacgcctggcgcttcgactacgtcaagggctatgctccctgggtcgtcagggactggctgaactggtggggaggctgggcagttggagagtactgggacaccaacgtcgacgctgttctcaactgggcatactcgagcggtgccaaggtctttgacttcgccctctactacaagatggacgaggccttcgataacaacaacattcccgccctggtggacgccctcagatacggccagacagtggtcagccgcgacccgttcaaggctgtgacgtttgtagccaaccacgataccgacataatctggaacaagtatccagcctacgcgttcatcctcacctacgagggccagccgacaatattctaccgcgactacgaggagtggctcaacaaggacaagctcaagaacctcatctggatacatgacaacctcgccggagggagcactgacatcgtttactacgacaacgacgagctgatattcgtgagaaacggctacggaagcaagccgggactgataacatacatcaacctcggctcaagcaaagccggaaggtgggtttacgttccgaagttcgcaggctcgtgcatacacgagtacaccggcaacctcggcggctgggtggacaagtgggtggactcaagcggctgggtttacctcgaggctcctgcccacgacccggccaacggccagtacggctactccgtttggagctattgcggtgttgggtga

SEQ ID NO: 76 - protein, 432 aa, Environmental
MALEEGGLIMQAFYWDVPMGGIWWDTIAQKIPDWASAGISAIWIPPASKGMSGGYSMGYDPYDYFDLGEYYQKGTVETRFGSKQELINMINTAHAYGMKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYAPWVVRDWLNWWGGWAVGEYWDTNVDAVLNWAYSSGAKVFDFALYYKMDEAFDNNNIPALVDALRYGQTVVSRDPFKAVTFVANHDTDIIWNKYPAYAFILTYEGQPTIFYRDYEEWLNKDKLKNLIWIHDNLAGGSTDIVYYDNDELIFVRNGYGSKPGLITYINLGSSKAGRWVYVPKFAGSCIHEYTGNLGGWVDKWVDSSGWVYLEAPAHDPANGQYGYSVWSYCGVG

SEQ ID NO: 77 - DNA, 1299 bp, Environmental
atggctctggaagagggcgggctcataatgcaggccttctactgggacgtccccatgggaggaatctggtgggacacgatagcccagaagatacccgactgggcaagcgccgggatttcggcgatatggatccctcccgcgagcaagggtatgagcggcggctattcgatgggctacgacccctacgattattttgacctcggtgagtactaccagaagggaacggtggaaacgaggttcggctcaaagcaggagctcataaacatgataaacaccgcccacgcctatggcatgaaggtaatagccgatatagtcatcaaccaccgcgccggcggtgacctggagtggaaccccttcgtgaacgactatacctggaccgacttctcaaaggtcgcgtcgggtaaatacacggccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggacgaggccttcgataacaacaacattcccgccctggtggacgccctcagatacggtcagacagtggtcagccgcgacccgttcaaggctgtgacgtttgtagccaaccacgataccgacataatctggaacaagtatccagcctacgcgttcatcctcacctacgagggccagccgacaatattctaccgcgactacgaggagtggctcaacaaggataagctcaagaacctcatctggatacatgacaacctcgccggagggagcactgacatcgtttactacgacaacgacgagctgatattcgtgagaaacggctacggaagcaagccgggactgataacatacatcaacctcgcctcaagcaaagccggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctactgcggtgttgggtga

SEQ ID NO: 78 - protein, 432 aa, Environmental
MALEEGGLIMQAFYWDVPMGGIWWDTIAQKIPDWASAGISAIWIPPASKGMSGGYSMGYDPYDYFDLGEYYQKGTVETRFGSKQELINMINTAHAYGMKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNNNIPALVDALRYGQTVVSRDPFKAVTFVANHDTDIIWNKYPAYAFILTYEGQPTIFYRDYEEWLNKDKLKNLIWIHDNLAGGSTDIVYYDNDELIFVRNGYGSKPGLITYINLASSKAGRWVYVPKFAGSCIHEYTGNLGGWVDKWVDSSGWVYLEAPAHDPANGQYGYSVWSYCGVG

SEQ ID NO: 79 - DNA, 1386 bp, Bacterial
atgaagcctgcgaaactcctcgtctttgtgctcgtagtctctatcctcgcggggctctacgcccagcccgcgggggcggccaagtacctggagctcgaagagggcggcgtcataatgcaggcgttctactgggacgtgccttcaggaggaatatggtgggacacaatacggcagaagataccggagtggtacgatgccggaatctccgcaatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacaccgcccacgcctacggcatcaaggtcatcgcagacatagtaatcaaccaccgcgccggaggagaccttgagtggaaccccttcgtcaatgactacacctggacggacttctcgaaggtcgcttccggcaagtacacggccaactacctcgacttccaccccaacgaggtcaagtgctgcgacgagggcacctttggagggttcccggacatagcccacgagaagagctgggaccagtactggctctgggcgagcaacgagagctacgccgcctacctcaggagcatcggcgttgacgcatggcgcttcgactacgtcaagggctacggagcgtgggtcgtcaaggactggctggactggtggggaggctgggccgtcggggagtactgggacacaaacgttgatgcactgctcaactgggcctactcgagcgatgcaaaagtcttcgacttcccgctctactacaagatggacgcggcctttgacaacaagaacattcccgcactcgtcgaggccctcaagaacgggggcacagtcgtcagccgcgacccgtttaaggccgtaaccttcgttgcaaaccacgacacggacataatttggaacaagtacccggcctacgccttcatcctcacctacgagggccagccgacgatattctaccgcgactacgaggagtggctcaacaaggacaggctcaagaacctcatctggatacacgaccacctcgccggtggaagcaccgacatagtctactacgataacgatgaactcatcttcgtcaggaacggctacggggacaagccggggcttataacctacatcaacctaggctcgagcaaggccgggaggtgggtctacgttccgaagttcgcgggagcgtgcatccacgagtacaccggcaacctcggcggctgggtggacaagtgggtggactcaagcgggtgggtgtacctcgaggcccctgcccacgacccggccaacggctattacggctactccgtctggagctactgcggggtgggctga

SEQ ID NO: 80 - protein, 461 aa, Bacterial
MKPAKLLVFVLVVSILAGLYAQPAGAAKYLELEEGGVIMQAFYWDVPSGGIWWDTIRQKIPEWYDAGISAIWIPPASKGMGGAYSMGYDPYDFFDLGEYDQKGTVETRFGSKQELVNMINTAHAYGIKVIADIVINHRAGGDLEWNPFVNDYTWTDFSKVASGKYTANYLDFHPNEVKCCDEGTFGGFPDIAHEKSWDQYWLWASNESYAAYLRSIGVDAWRFDYVKGYGAWVVKDWLDWWGGWAVGEYWDTNVDALLNWAYSSDAKVFDFPLYYKMDAAFDNKNIPALVEALKNGGTVVSRDPFKAVTFVANHDTDIIWNKYPAYAFILTYEGQPTIFYRDYEEWLNKDRLKNLIWIHDHLAGGSTDIVYYDNDELIFVRNGYGDKPGLITYINLGSSKAGRWVYVPKFAGACIHEYTGNLGGWVDKWVDSSGWVYLEAPAHDPANGYYGYSVWSYCGVG

SEQ ID NO: 81 - DNA, 1386 bp, Bacterial
atgaagaagtttgtcgccctgttcataaccatgtttttcgtagtgagcatggcagtcgttgcacagccagctagcgccgcaaagtattccgagctcgaagaaggcggcgttataatgcaggccttctactgggacgtcccaggtggaggaatctggtgggacaccatcaggagcaagataccggagtggtacgaggcgggaatatccgccatttggattccgccagccagcaaggggatgagcggcggttactcgatgggctacgatccctacgatttctttgacctcggcgagtacaaccagaagggaaccatcgaaacgcgctttggctctaaacaggagctcatcaatatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgctttgactacgtgaagggctacggagcgtgggtcgtcaaggactggctcaactggtggggcggctgggccgttggcgagtactgggacaccaacgttgatgcactcctcaactgggcctactcgagcggcgccaaggtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtaccttgcttatgctttcatcctcacctacgaaggccagcccgtcatattctaccgcgactacgaggagtggctcaacaaggacaggttgaacaacctcatatggatacacgaccacctcgcaggtggaagcacgagcatagtctactacgacagcgacgagatgatcttcgtgaggaacggctatggaagcaagcctggccttataacttacatcaacctcggctcgagcaaggttggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctattgcggtgttgggtga

SEQ ID NO: 82 - protein, 461 aa, Bacterial
MKKFVALFITMFFVVSMAVVAQPASAAKYSELEEGGVIMQAFYWDVPGGGIWWDTIRSKIPEWYEAGISAIWIPPASKGMSGGYSMGYDPYDFFDLGEYNQKGTIETRFGSKQELINMINTAHAYGIKVIADIVINHRAGGDLEWNPFVGDYTWTDFSKVASGKYTANYLDFHPNEVKCCDEGTFGGFPDIAHEKSWDQHWLWASDESYAAYLRSIGVDAWRFDYVKGYGAWVVKDWLNWWGGWAVGEYWDTNVDALLNWAYSSGAKVFDFPLYYKMDEAFDNKNIPALVSALQNGQTVVSRDPFKAVTFVANHDTDIIWNKYLAYAFILTYEGQPVIFYRDYEEWLNKDRLNNLIWIHDHLAGGSTSIVYYDSDEMIFVRNGYGSKPGLITYINLGSSKVGRWVYVPKFAGACIHEYTGNLGGWVDKYVYSSGWVYLEAPAYDPANGQYGYSVWSYCGVG

SEQ ID NO: 83 - DNA, 1299 bp, Environmental
atggctctggaagacggcgggctcataatgcaggccttctactgggatgttcctggaggaggaatctggtgggacacaatagctcaaaagatacccgaatgggcaagtgcaggaatctcagcgatatggattccaccagcgagtaagggcatgagcggtggttattccatgggctacgatccctacgatttctttgacctcggcgagtactatcagaaggggacagttgagacgcgcttcggctcaaaggaagaactggtgaacatgataaacaccgcacactcctacggcataaaggtgatagcagacatagtcataaaccaccgcgccggtggagaccttgagtggaaccccttcgtgaacgactatacctggacagacttctcaaaagtcgcctccggtaaatatacggccaactaccttgacttccacccaaacgagcttcactgttgtgatgaaggtacctttggaggataccctgatatatgtcacgacaaaagctgggaccagtactggctctgggcgagcagcgaaagctacgctgcctacctcaggagcataggggttgacgcctggcgtttcgactacgtcaagggctacggagcatgggttgttaacgactggctcagctggtggggaggctgggccgttggagagtactgggacacgaacgttgatgcactcctcaactgggcatacagcagcggcgccaaggtctttgacttcccgctctactacaagatggacgaagccttcgacaacaccaacatcccggcattagtggatgcactcagatacggccagacagtggtcagccgcgatcccttcaaggcggtaactttcgttgccaaccacgatacagatataatctggaacaagtatccggcttatgcattcatccttacctatgagggacagcctgttatattctaccgcgactacgaggagtggctcaacaaggataagcttaacaacctcatctggatacacgatcaccttgctggagggagtactgacattgtttactacgacagcgacgagcttatctttgtgagaaacggctatggcaccaaaccaggactgataacctatatcaacctcggctcaagcaaagttggaaggtgggtctacgttccaaagttcgccggttcatgcatccacgagtacaccggcaacctcggcggttggatagacaagtacgtctcctccagcggctgggtctatcttgaggccccagcccacgacccggcgaacggctactacggctactccgtatggagctactgcggggttgggtga

SEQ ID NO: 84 - protein, 432 aa, Environmental
MALEDGGLIMQAFYWDVPGGGIWWDTIAQKIPEWASAGISAIWIPPASKGMSGGYSMGYDPYDFFDLGEYYQKGTVETRFGSKEELVNMINTAHSYGIKVIADIVINHRAGGDLEWNPFVNDYTWTDFSKVASGKYTANYLDFHPNELHCCDEGTFGGYPDICHDKSWDQYWLWASSESYAAYLRSIGVDAWRFDYVKGYGAWVVNDWLSWWGGWAVGEYWDTNVDALLNWAYSSGAKVFDFPLYYKMDEAFDNTNIPALVDALRYGQTVVSRDPFKAVTFVANHDTDIIWNKYPAYAFILTYEGQPVIFYRDYEEWLNKDKLNNLIWIHDHLAGGSTDIVYYDSDELIFVRNGYGTKPGLITYINLGSSKVGRWVYVPKFAGSCIHEYTGNLGGWIDKYVSSSGWVYLEAPAHDPANGYYGYSVWSYCGVG

SEQ ID NO: 85 - DNA, 1299 bp, Environmental
atggctctggaagagggcgggcttataatgcaggcattctattgggacgtcccaggtggaggaatctggtgggacaccatagcccagaagatacccgaatgggcaagtgcaggaatctcagcgatatggattccaccagcgagtaagggaatgagcggtggttattccatgggctacgatccctacgatttctttgacctcggcgagtactatcagaaggggacagttgagacgcgcttcggctcaaaggaagaactggtgaacatgataaacaccgcacactcctacggcataaaggtgatagcggacatagtcataaaccaccgcgccggtggaggcctcgagtggaaccccttcgtgaacgactatacctggacagacttctcaaaagtcgcctccggtaaatatacagccaactaccttgacttccacccaaacgagcttcactgttgtgatgaaggtacctttggaggataccctgatatatgtcacgacaaaagctgggaccagtactggctctgggcgagcagcgaaagctacgctgcctacctcaggagcataggggttgacgcctggtgtttcgactacgtcaagggctacggagcctgggttgttaacgactggctcagctggtggggaggctgggccgttggagagtactgggacactaacgttgatgcactcctcaactgggcatacaacagcggcgccaaggtctttgacttcccgctctactacaagatggacgaagccttcgacaataccaacatccccgctttggtttacgccctcaagaatggcgggacagtggtcagccgcgacccattcaaggcggtaactttcgttgccaaccacgatacagatataatctggaacaagtatccggcttatgcattcatccttacctatgagggacagcctgttatattctaccgcgactacgaggagtggctcaacaaggataagcttaacaacctcatctggatacacgatcaccttgctggagggagtactgacattgtttactacgacagcgacgagcttatctttgtgagaaacggctatggcaccaaaccaggactgataacctatatcaacctcggctcaagcaaagctggaaggtgggtctacgttccaaagttcgccggttcatgcatccacgagtacaccggcagcctcggcggttggatagacaagtacgtctcctccagcggctgggtctaccttgaggccccggcccacgacccggccaatggccagtatggctactccgtctggagctattgcggggttgggtga

SEQ ID NO: 86 - protein, 432 aa, Environmental
MALEEGGLIMQAFYWDVPGGGIWWDTIAQKIPEWASAGISAIWIPPASKGMSGGYSMGYDPYDFFDLGEYYQKGTVETRFGSKEELVNMINTAHSYGIKVIADIVINHRAGGGLEWNPFVNDYTWTDFSKVASGKYTANYLDFHPNELHCCDEGTFGGYPDICHDKSWDQYWLWASSESYAAYLRSIGVDAWCFDYVKGYGAWVVNDWLSWWGGWAVGEYWDTNVDALLNWAYNSGAKVFDFPLYYKMDEAFDNTNIPALVYALKNGGTVVSRDPFKAVTFVANHDTDIIWNKYPAYAFILTYEGQPVIFYRDYEEWLNKDKLNNLIWIHDHLAGGSTDIVYYDSDELIFVRNGYGTKPGLITYINLGSSKAGRWVYVPKFAGSCIHEYTGSLGGWIDKYVSSSGWVYLEAPAHDPANGQYGYSVWSYCGVG

SEQ ID NO: 87 - DNA, 1419 bp, Environmental
atgttcctgctcgcgtttttgctcactgcctcgctgttctgcccaacaggacagcccgccaaggctgccgcaccgtttaacggcaccatgatgcagtattttgaatggtacttgccggatgatggcacgttatggaccaaagtggccaatgaagccaacaacttatccagccttggcatcaccgctctttggctgccgcccgcttacaaaggaacaagccgcagcgacgtagggtacggagtatacgacttgtatgacctcggcgaattcaatcaaaaagggaccgtccgcacaaaatacggaacaaaagctcaatatcttcaagccattcaagccgcccacgccgctggaatgcaagtgtacgccgatgtcgtgttcgaccataaaggcggcgctgacggcacggaatgggtggacgccgtcgaagtcaatccgtccgaccgcaaccaagaaatctcgggcacctatcaaatccaagcatggacgaaatttgattttcccgggcggggcaacacctactccagctttaagtggcgctggtaccattttgacggcgttgattgggacgaaagccgaaaattgagccgcatttacaaattccgcggcatcggcaaagcgtgggattgggaagtagacacggaaaacggaaactatgactacttaatgtatgccgaccttgatatggatcatcccgaagtcgtgaccgagctgaaaaactgggggaaatggtatgtcaacacaacgaacattgatgggttccggcttgatgccgtcaagcatattaagttcagtttttttcctgattggttgtcgtatgtgcgttctcagactggcaagccgctatttaccgtcggggaatattggagctatgacatcaacaagttgcacaattacattacgaaaacagacggaacgatgtctttgtttgatgccccgttacacaacaaattttataccgcttccaaatcagggggcgcatttgatatgcgcacgttaatgaccaatactctcatgaaagatcaaccgacattggccgtcaccttcgttgataatcatgacaccgaacccggccaagcgctgcagtcatgggtcgacccatggttcaaaccgttggcttacgcctttattctaactcggcaggaaggatacccgtgcgtcttttatggtgactattatggcattccacaatataacattccttcgctgaaaagcaaaatcgatccgctcctcatcgcgcgcagggattatgcttacggaacgcaacatgattatcttgatcactccgacatcatcgggtggacaagggaaggggtcactgaaaaaccaggatccgggctggccgcactgatcaccgatgggccgggaggaagcaaatggatgtactgttggcaaacaacacgctggaaaagtgttctatga

SEQ ID NO: 88 - protein, 472 aa, Environmental
MFLLAFLLTASLFCPTGQPAKAAAPFNGTMMQYFEWYLPDDGTLWTKVANEANNLSSLGITALWLPPAYKGTSRSDVGYGVYDLYDLGEFNQKGTVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPEVVTELKNWGKWYVNTTNIDGFRLDAVKHIKFSFFPDWLSYVRSQTGKPLFTVGEYWSYDINKLHNYITKTDGTMSLFDAPLHNKFYTASKSGGAFDMRTLMTNTLMKDQPTLAVTFVDNHDTEPGQALQSWVDPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYCWQTTRWKSVL

SEQ ID NO: 89 - DNA, 3301 bp, Bacterial
atgaaagaagcggttgtgtatcaaattttcccggatcggttctttaatggcaacccttcaaatgataacagcaagcagcaggcacgcggggcgcagccgattgagcatcgcgattggtcggatttgcccgataatccgcgcctgaaagggacgagcggctacgatggcgacggtgaatggtcgaatgactttttcggcggagacatcgccggaattgaacaaaagttggattatttgcagtcgcttggagtgaacacgatttacttaaatccgatcgccaatgcgccatcgaaccataaatatgatgcgagcaattacaaagaattggatccgatgttcggttccccggaagaattccaatcgtttgtgcaggcgcttgcgaaccgggggatgcatctcatcttagacggggtgttcaaccacgtatccgacgattcgatttactttgaccgctaccaccgctatccgaccgtcggtgcgtatgaatattgggaagcggtttacgatttgatgaatgaaaaaggattgagcgaggaagaagcgcggaaacaagtggaagagaagttcaaacaagagggacagacgttcagcccgtatgggtttcatctttggttcaatattgaaaacaaaaaagtcaatggccattatcaataccaatcatggtggggctatgacagtctgccggagtttaagtcggtgacgggggaaaaagtgccgcatccgagtgaattgaacaacgatgcgctcgcgaattacattttccgtgaatcggattcggtggcgaaaagctggattgccctcggcgcctccggctggcggttggatgtggccaatgaggtggatccggcgttttggcgcgagtttcgccaagaattgcttcaagggtcgtacggccgcggtccgacgttaaaagagggggagcagccgctcattttaggggaaatttgggatgacgcatcgaaatattttctaggcgaccagtacgattccgtgatgaactaccggttccgcggggcggtgcttgactttttgaaaaacggaaatgcagaagaggcggacaagcggctgacggccataagggaagactacccaagtgaagcgttttatgcgctgatgaacttaatcggttcgcatgacacggcgcgggcggtctttctgcttgggaacggaacggattcatccgagcgggcggagcttgatccgaattataatgaggaacttgggaaaaagcggctcaagctggcggtgattttgcagatgggatacccgggagcgccgacgatttattacggcgatgaagcgggagtaacaggctcaaaagacccagacaaccgccgcacgtatccgtggggcaaagaagatcaaaatctgttgtcccattatcagaaagtggggcacattcgccagcaccatcaatcgttgttggcccatggcgacatcaagacggtgtatgcgcaaggggatgtatacgtatttgcccgccaatacgggcgtgaagcggcgctcattgccatcaaccgcggcaatgaggacaagacggtggcgcttgacgtcgcttcgttgcttccgaacggcaccgtgcttacggatgagttgcatgatggcggggaagctacggtcgctggcggaacgttgacggtcacgattccggccctggatggacggatgatgtttgggacggtgacggcggaaatgccggcagcagtcagcaatttgcaggcgagcgcttcggatggctgcgtgacgttaacgtgggaaggaaatgcatcgagataccgaatttacgagtccacgttaaaaggtgccggttatacgatggtgcaagagacggaaacaacttcggccacgatcggttcgttgacgaacggaacagcctattactttgccgttgcggcggtcgatgaaaacgggaatgaatcaccgaaggtcgaaacgaatcgcgtcgttcctcattacccgctgacgagcgacaatgtccagttcgtgacaacgttaagcgatgccacactggatttgtcaaagccgcagcaagtggatgtccatgtcaacatcgacaatgtgacaagcaaaggagcagctgatgggttgcaagcggtgttgcaagtgaaaggcccgcatgacgaaacatggaaagaatacagagcggcttaccaaggacaagacggcgacgccaacgtgttccgagctgccttcactccgctcgccgcagggacgtatacgtatcgttatgcgctgacgaccaaccttggcgaggagtggatgtatacagaagagaagcaagtgacgtttgcggcagacaacagcgaccaaatagcgccagcagacgccatcgagctgcggcagcctgcggttgaatcgggacaagtgaatttatcatggacgtttgttgggaaaaaagatggggatgcttatttgttagccatcgagcgcaacggtgatatcgtgcatacaaccacttcgatcggcgattcatttacagactacgatgtcgaaaacggcaccgagtacacgtatgttgtcaagttgtatgaccgcgccggcaatgttgtggcgtcaaacacggtcaaggtgacgccggacattgtgatggtgaaagtgatttttaaagtgagagcgccggattacacaccgttggatgcccgaattacgattccgaacagcttgaacggctggaacacaggggcctgggagatgtcgcgcaacggtgcggtgacgcccgattggcaatttaccgtcgaggtgcaggaaggggaaacgatcacctataagtatgtgaaaggcggatcgtgggatcaagaggggttggccgaccatacgcgtgaggacgacaacgatgatgacgtgagctactacggctatgggacgattggcaccgacttgaaagtgacggtccacaatgaaggaaacaatacgatgattgtgcaagaccgcattttgcgctggatcgatatgccggtcgtcatcgaagaggtgcaaaaacaaggaagtcaagtgacgatcaagggcaatgccattaaaaacggtgttttgacgatcaatggcgagcgggtgccgattgatggccggatggcattctcgtacacgtttgcgccggccagccatcaaaaagaagtgttgatccatatcgaaccatcggccgaaagcaaaacagccattttcaacaacgacggcggagcgattgcgaaaaacacaaaagattacgtgctgaatttagaaacgaagcaattcaaaaagcttctcgagagtacttctagagcggccgcgggcccatcgattttccacccgggtggggtaccaggta

SEQ ID NO: 90 - protein, 1100 aa, Bacterial
MKEAVVYQIFPDRFFNGNPSNDNSKQQARGAQPIEHRDWSDLPDNPRLKGTSGYDGDGEWSNDFFGGDIAGIEQKLDYLQSLGVNTIYLNPIANAPSNHKYDASNYKELDPMFGSPEEFQSFVQALANRGMHLILDGVFNHVSDDSIYFDRYHRYPTVGAYEYWEAVYDLMNEKGLSEEEARKQVEEKFKQEGQTFSPYGFHLWFNIENKKVNGHYQYQSWWGYDSLPEFKSVTGEKVPHPSELNNDALANYIFRESDSVAKSWIALGASGWRLDVANEVDPAFWREFRQELLQGSYGRGPTLKEGEQPLILGEIWDDASKYFLGDQYDSVMNYRFRGAVLDFLKNGNAEEADKRLTAIREDYPSEAFYALMNLIGSHDTARAVFLLGNGTDSSERAELDPNYNEELGKKRLKLAVILQMGYPGAPTIYYGDEAGVTGSKDPDNRRTYPWGKEDQNLLSHYQKVGHIRQHHQSLLAHGDIKTVYAQGDVYVFARQYGREAALIAINRGNEDKTVALDVASLLPNGTVLTDELHDGGEATVAGGTLTVTIPALDGRMMFGTVTAEMPAAVSNLQASASDGCVTLTWEGNASRYRIYESTLKGAGYTMVQETETTSATIGSLTNGTAYYFAVAAVDENGNESPKVETNRVVPHYPLTSDNVQFVTTLSDATLDLSKPQQVDVHVNIDNVTSKGAADGLQAVLQVKGPHDETWKEYRAAYQGQDGDANVFRAAFTPLAAGTYTYRYALTTNLGEEWMYTEEKQVTFAADNSDQIAPADAIELRQPAVESGQVNLSWTFVGKKDGDAYLLAIERNGDIVHTTTSIGDSFTDYDVENGTEYTYVVKLYDRAGNVVASNTVKVTPDIVMVKVIFKVRAPDYTPLDARITIPNSLNGWNTGAWEMSRNGAVTPDWQFTVEVQEGETITYKYVKGGSWDQEGLADHTREDDNDDDVSYYGYGTIGTDLKVTVHNEGNNTMIVQDRILRWIDMPVVIEEVQKQGSQVTIKGNAIKNGVLTINGERVPIDGRMAFSYTFAPASHQKEVLIHIEPSAESKTAIFNNDGGAIAKNTKDYVLNLETKQFKKLLESTSRAAAGPSIFHPGGVPG

SEQ ID NO: 91 - DNA, 1650 bp, Bacterial
gtgctaacgtttcaccgcatcattcgaaaaggatggatgttcctgctcgcgtttttgctcactgcctcgctgttctgcccaacaggacagcccgccaaggctgccgcaccgtttaacggcaccatgatgcagtattttgaatggtacttgccggatgatggcacgttatggaccaaagtggccaatgaagccaacaacttatccagccttggcatcaccgctctttggctgccgcccgcttataaaggaacaagccgcagcgacgtagggtacggagtatacgacttgtatgacctcggcgaattcaatcaaaaagggaccgtccgcacaaaatacggaacaaaagctcaatatcttcaagccattcaagccgcccacgccgctggaatgcaagtgtacgccgatgtcgtgttcgaccataaaggcggcgccgacggcacggaatgggtggacgccgtcgaagtcaatccgtccgaccgcaaccaagaaatctcgggcacctatcaaatccaagcatggacgaaatttgattttcccgggcggggcaacacctactccagctttaagtggcgctggtaccattttgacggcgttgattgggacgaaagccgaaaattgagccgcatttacaaattccgcggcatcggcaaagcgtgggattgggaagtagacacggaaaacggaaactatgactacttaatgtatgccgacttggacatggaccatcctgaagtggttacggaactgaaaaactggggcaaatggtatgtcaacacaacgaacattgatgggttccggcttgatgccgtcaagcatattaagttcagtttttttcctgattggttgtcgtatgtgcgttctcagactggcaagccgctatttaccgtcggggaatattggagctatgacatcaacaagttgcacaattacattacgaaaacaaacggaacgatgtctttgtttgatgccccgttacacaacaaattttataccgcttccaaatcagggggcgcatttgatatgcgcacgttaatgaccaatactctcatgaaagatcaaccgacattggccgtcaccttcgttgataatcatgacaccgaacccggccaagcgctgcagtcatgggtcgacccatggttcaaaccgttggcttacgcctttattctaactcggcaggaaggatacccgtgcgtcttttatggtgactattatggcatcccacaatataacattccttcgctgaaaagcaaaatcgatccgctcctcatcgcgcgcagggattatgcttacggaacgcaacatgattatcttgatcactccgacatcatcgggtggacaagggaaggcgtcactgaaaaaccaggatccggactggccgcactgatcaccgatgggccgggaggaagcaaatggatgtacgttggcaaacaacacgccggaaaagtgttctatgaccttaccggcaaccggagtgacaccgtcaccatcaacagtgatggatggggagaattcaaagtcaatggcggttcggtttcggtttgggttcctagaaaaacgaccgtctctaccatcgcttggccgatcacaacccgaccgtggactggtgaattcgtccgttggaccgaaccacggttggtggcatggccttga

SEQ ID NO: 92 - protein, 549 aa, Bacterial
VLTFHRIIRKGWMFLLAFLLTASLFCPTGQPAKAAAPFNGTMMQYFEWYLPDDGTLWTKVANEANNLSSLGITALWLPPAYKGTSRSDVGYGVYDLYDLGEFNQKGTVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPEVVTELKNWGKWYVNTTNIDGFRLDAVKHIKFSFFPDWLSYVRSQTGKPLFTVGEYWSYDINKLHNYITKTNGTMSLFDAPLHNKFYTASKSGGAFDMRTLMTNTLMKDQPTLAVTFVDNHDTEPGQALQSWVDPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTINSDGWGEFKVNGGSVSVWVPRKTTVSTIAWPITTRPWTGEFVRWTEPRLVAWP

SEQ ID NO: 93 - DNA, 1545 bp, Bacterial
atgaaatcgtttgcattcatgcctatccttttttatgcaaacgatttcatcagtgaaagggaaggaggaggaaaaatggggaagaatatgagaagaagattcacgtatttttcaatcttcttattgttcgttcagctgttttcatttagtgcaaccgctagcgccaatggaacggtgaacagtagtcctgtggttaatggaaacgaagtcacgtttctatatggaggaacaggaaacgagcagtctgtgttactggcaggctcctttaatgattggcagaaagatggtgacaagaagattgcactaacaaaaggcgacaataacgtctggtctgtcacgcaaacacttcaagatgggacatatacgtataagtttgttgtagatggtcaatgggtggcggatccgcttaacccgaatcaagtagacgacggttacggcggccgtaatagtgtcgttgttgtcgggacaccggtgcaacaagaacggacagtgacgcttgttggtaacttacaagacgaattaggtcatacgagcgaatgggatccgaaagcgacagctacagtgatgaaaaaggaagggaacgggttatatacgtttacaggtacacttccagccggaacgtacgagtataaaattgcgattaatggcagctgggacgaaaactatggtgtcggcggccgcgatggcgggaatattaagctgctattaaatgaacaaacaacggttacattttattacaacgacagaacgcatgcgattgcggattcgacttggtatgcaccaattctaaaagaaaagcagccgcggctcgttggaacgattttaccagctattggttatgaaacagacgtgaacggttggacgccgcaaacatcaacggcgttgttgtcagatgatgattttgattccatttatacgtttaaggcgcgtgtgccaaaagggacatatgaatataaagtagttcttgggaatgattggacatatgaaaattatccacaagataatgccaaattaaatgtgcttgaagaaacgacaattacctttttctttaacgcgaaaacgaaagtagtgtataccgattacaatccaagcggttcggatggtatcgtccaaaaagaccgtttgaagcataatacgtgggattcgttgtatcgccaaccgtttggtgcggtgaaagctgggacagaagtgacccttcgtttatcagcgaaaaaaggtgatttgacaaaagcggatgtatatgtaaaaaatacgacaaccggcacagcgaaactatattcgatgaaaaaagccggtgttcttggcgaagaagaatattgggaagcgacattcacaccggatgtgaaaggagtatacggttataaatttattgcggtagatgctggaacgaaagcagaatacggggaagatacacaagaagggcagtggggaaaagcagtagataaaaatgcagagctgttccaattaacggtgtacgacccatcctaccaaacaccggattggatgaaagaagcagttgtatatcaaattttccctgatccaaag

SEQ ID NO: 94 - protein, 515 aa, Bacterial
MKSFAFMPILFYANDFISEREGGGKMGKNMRRRFTYFSIFLLFVQLFSFSATASANGTVNSSPVVNGNEVTFLYGGTGNEQSVLLAGSFNDWQKDGDKKIALTKGDNNVWSVTQTLQDGTYTYKFVVDGQWVADPLNPNQVDDGYGGRNSVVVVGTPVQQERTVTLVGNLQDELGHTSEWDPKATATVMKKEGNGLYTFTGTLPAGTYEYKIAINGSWDENYGVGGRDGGNIKLLLNEQTTVTFYYNDRTHAIADSTWYAPILKEKQPRLVGTILPAIGYETDVNGWTPQTSTALLSDDDFDSIYTFKARVPKGTYEYKVVLGNDWTYENYPQDNAKLNVLEETTITFFFNAKTKVVYTDYNPSGSDGIVQKDRLKHNTWDSLYRQPFGAVKAGTEVTLRLSAKKGDLTKADVYVKNTTTGTAKLYSMKKAGVLGEEEYWEATFTPDVKGVYGYKFIAVDAGTKAEYGEDTQEGQWGKAVDKNAELFQLTVYDPSYQTPDWMKEAVVYQIFPDPK

SEQ ID NO: 95 - DNA, 1524 bp, Bacterial
atgtatacactattcatccgttcatattttgatactgatggtgatggtgtaggagactttagtggagttgctgaaaaggtagattatctaaaatctcttggagtagatacagtctggtttttaccatttaataaaagtaaatcttatcatggatatgatgttgaagattactatgatgtagaaccagattatggaacactacaagatcttgataatatgataaaagttctaaatgaaaatggaataaaggtagtaatggatcttgttgttaatcatacgtcggatacacatccatggtttcttgatgcagttgaaaatactactaattctccatattggaactattacattatgagcttggatgagcctcaaaataagaatcattggcattataaggttaattcaaaaggacaaactgtgtggtattttggattgtttgattcatcaatgccggaccttaattacgacaaccctaaagtaatggatgaagtgaaaaaaataatagatttttgggcagatatgggagtagatggatttagattagatgcagcaaaacattattatggatttgactggagcgatggaattgaacagtcagcaagcgttgcaaaagagatagaagactatataaaagataaactaggggaaaatgcaatagttgtgagtgaggtttacgatggagattcaaatgttcttttaaaatttgctccaatgcctgtgtttaattttagttttatgtacaatttgagaggaaattttgaagggagagataacttaatttcagactctattagttgggttgattcctcgttgtataatttaaatgtttttcattttccatttattgatagtcatgatcttgacagatttatttctgagcttgtagatagtaaatatcagggagatgtaatatctgccacaaaacaatatttgctagttaatgctttactactctcattaacaggcatgccaactatttactatggtgatgaaataggacttaggggatggaagtggcattcagaaccatgggatatacctgtgcgtgagccaatgcaatggtataaggatcaaaaagggaacggtcaaacttattggacaaaagagttttacgaaggtattactgaaggaagtgctaatgaagatggagcaatatacgatgatccagatgatggagtatctgtagaagaacaagaaaatggatattctattttaaacttttttaaagaatttatcaacttacgaaaagattatccggcacttgcttttggaagtactacgattgagagagattggaaaaacttgtatgttttgaaaaagtcgtataacttccaggatgttcttgtattaattaaccttgatccaacgtattcaaatacatacgaagttccagaagggtataaatgggtgtggtatgcattttttgatggtgacaactatgaatttggagcaaaagatgaaatgattttacagaatacaagttggacgataaatccaaggcaaatttatatatttgtaaagtaa

SEQ ID NO: 96 - protein, 507 aa, Bacterial
MYTLFIRSYFDTDGDGVGDFSGVAEKVDYLKSLGVDTVWFLPFNKSKSYHGYDVEDYYDVEPDYGTLQDLDNMIKVLNENGIKVVMDLVVNHTSDTHPWFLDAVENTTNSPYWNYYIMSLDEPQNKNHWHYKVNSKGQTVWYFGLFDSSMPDLNYDNPKVMDEVKKIIDFWADMGVDGFRLDAAKHYYGFDWSDGIEQSASVAKEIEDYIKDKLGENAIVVSEVYDGDSNVLLKFAPMPVFNFSFMYNLRGNFEGRDNLISDSISWVDSSLYNLNVFHFPFIDSHDLDRFISELVDSKYQGDVISATKQYLLVNALLLSLTGMPTIYYGDEIGLRGWKWHSEPWDIPVREPMQWYKDQKGNGQTYWTKEFYEGITEGSANEDGAIYDDPDDGVSVEEQENGYSILNFFKEFINLRKDYPALAFGSTTIERDWKNLYVLKKSYNFQDVLVLINLDPTYSNTYEVPEGYKWVWYAFFDGDNYEFGAKDEMILQNTSWTINPRQIYIFVK

SEQ ID NO: 97 - DNA, 2931 bp, Bacterial
atgaggaagaagatgtcgcattcaagatttacttttcttttgatcttagcactttttattttcttctccggttgtatttcagaagttaaaagcgaaagccagctactaaattcaaagcaaaaggtccttgtaaaagtaaatgttaatacgccatttattgagaatgctactactaatacgtggagtgtttcaaaagaatcttttattgattatcttagtaaagtgattattactgttaaggatgtaaatgatcagattgtatttactaaggaaacaacgaacaaaacaaatatttattttgaaattgaacttcttcctggaacttatacatttgaggtaaaaggatatgaggaagatttagttatattttcaggggaaaaagttaatcagatcatagatgagaaaaataatattgttaatgtcgaaactttttttgttaatggaatagttaggacaataattgaagttgacgatattatttataaaaattatgatattacatcggcaacgttgatcttcaaaaaagatacagcacaagaagattatgaagaggtacctgtaacacttacaggtacttccactttaattaataaagaattatatcctggtatgtggactgtaaaatttgaagttgatcttaaatcaaaggatgcaagtatgttaccagaaaaagttcatcttgaaaatgaatttagcatagaagtgcttccagcaaagacaaaaagtttaacatttaatgtagtctttgatacagaggttaatgaaccgaaattagtagttgtatttccgcaaattgagttgccttttgtggatcctgtaacaaatttaagtggagagataaatgaattagaagggaatctttcaatgaattgggactattcagatccaaatgcagaattttatgtgtataaagaattagaggaacaaggagaatatttgtatgaatttgttggaaaaacacgcgagaaaagttatacaatagaaaattttaccaagcaagaattcgataaatttagtggaatcgctattaatgtttatgccaacggtaaagagagtggattagttgttctaaaaaaagaaaatattaaacttatagatttagaaagtgttgacagtataagtgctacttataacgttgatacgaatgagcttaagttggattggaattataccaattcaagtgttacttttgaagttttgaaaaaaggtataaatagcaatgaatacgaaataatttctcaactaacacaaaattctttttcaacagaattcacaggcaggcaattttgggatcttgagaaaattgcgattagagtagttgctaatggatttgaaagtaagattaatgagatttcaagagatgatataactataacatcattgaatcttcctcttacatcgtctactatgtatacactattcatccgttcatattttgatactgatggtgatggtgtaggagactttagtggagttgctgaaaaggtagattatctaaaatctcttggagtagatacagtctggtttttaccatttaataaaagtaaatcttatcatggatatgatgttgaagattactatgatgtagaaccagattatggaacactacaagatcttgataatatgataaaagttctaaatgaaaatggaataaaggtagtaatggatcttgttgttaatcatacgtcggatacacatccatggtttcttgatgcagttgaaaatactactaattctccatattggaactattacattatgagcttggatgagcctcaaaataagaatcattggcattataaggttaattcaaaaggacaaactgtgtggtattttggattgtttgattcatcaatgccggaccttaattacgacaaccctaaagtaatggatgaagtgaaaaaaataatagatttttgggcagatatgggagtagatggatttagattagatgcagcaaaacattattatggatttgactggagcgatggaattgaacagtcagcaagcgttgcaaaagagatagaagactatataaaagataaactaggggaaaatgcaatagttgtgagtgaggtttacgatggagattcaaatgttcttttaaaatttgctccaatgcctgtgtttaattttagttttatgtacaatttgagaggaaattttgaagggagagataacttaatttcagactctattagttgggttgattcctcgttgtataatttaaatgtttttcattttccatttattgatagtcatgatcttgacagatttatttctgagcttgtagatagtaaatatcagggagatgtaatatctgccacaaaacaatatttgctagttaatgctttactactctcattaacaggcatgccaactatttactatggtgatgaaataggacttaggggatggaagtggcattcagaaccatgggatatacctgtgcgtgagccaatgcaatggtataaggatcaaaaagggaacggtcaaacttattggacaaaagagttttacgaaggtattactgaaggaagtgctaatgaagatggagcaatatacgatgatccagatgatggagtatctgtagaagaacaagaaaatggatattctattttaaacttttttaaagaatttatcaacttacgaaaagattatccggcacttgcttttggaagtactacgattgagagagattggaaaaacttgtatgttttgaaaaagtcgtataacttccaggatgttcttgtattaattaaccttgatccaacgtattcaaatacatacgaagttccagaagggtataaatgggtgtggtatgcattttttgatggtgacaactatgaatttggagcaaaagatgaaatgattttacagaatacaagttggacgataaatccaaggcaaatttatatatttgtaaagtaa

SEQ ID NO: 98 - protein, 976 aa, Bacterial
MRKKMSHSRFTFLLILALFIFFSGCISEVKSESQLLNSKQKVLVKVNVNTPFIENATTNTWSVSKESFIDYLSKVIITVKDVNDQIVFTKETTNKTNIYFEIELLPGTYTFEVKGYEEDLVIFSGEKVNQIIDEKNNIVNVETFFVNGIVRTIIEVDDIIYKNYDITSATLIFKKDTAQEDYEEVPVTLTGTSTLINKELYPGMWTVKFEVDLKSKDASMLPEKVHLENEFSIEVLPAKTKSLTFNVVFDTEVNEPKLVVVFPQIELPFVDPVTNLSGEINELEGNLSMNWDYSDPNAEFYVYKELEEQGEYLYEFVGKTREKSYTIENFTKQEFDKFSGIAINVYANGKESGLVVLKKENIKLIDLESVDSISATYNVDTNELKLDWNYTNSSVTFEVLKKGINSNEYEIISQLTQNSFSTEFTGRQFWDLEKIAIRVVANGFESKINEISRDDITITSLNLPLTSSTMYTLFIRSYFDTDGDGVGDFSGVAEKVDYLKSLGVDTVWFLPFNKSKSYHGYDVEDYYDVEPDYGTLQDLDNMIKVLNENGIKVVMDLVVNHTSDTHPWFLDAVENTTNSPYWNYYIMSLDEPQNKNHWHYKVNSKGQTVWYFGLFDSSMPDLNYDNPKVMDEVKKIIDFWADMGVDGFRLDAAKHYYGFDWSDGIEQSASVAKEIEDYIKDKLGENAIVVSEVYDGDSNVLLKFAPMPVFNFSFMYNLRGNFEGRDNLISDSISWVDSSLYNLNVFHFPFIDSHDLDRFISELVDSKYQGDVISATKQYLLVNALLLSLTGMPTIYYGDEIGLRGWKWHSEPWDIPVREPMQWYKDQKGNGQTYWTKEFYEGITEGSANEDGAIYDDPDDGVSVEEQENGYSILNFFKEFINLRKDYPALAFGSTTIERDWKNLYVLKKSYNFQDVLVLINLDPTYSNTYEVPEGYKWVWYAFFDGDNYEFGAKDEMILQNTSWTINPRQIYIFVK

SEQ ID NO: 99 - DNA, 1536 bp, Bacterial
atgtacacactcttcatccgctctttttacgatacaaacaacgacggtgtaggtgactacaacggtgttgcccaaaaagtagactatctcaaaacgcttggagtggatacagtttggttcttgccgttcaacaaagcaaaatcgtaccacggttacgatgttgaagactactacgatgtagaacctgactatggaacatacgcacaacttgaaaatatgataaagacactcaatcagaacggaattcgtgttgttatggacttggttgtgaaccacacttccgatacacactcgtggtttctggatgccgttgagaacacaacgaattcgaaatattggagctactacataatgacacttgaaaatagagacggttggaatcactggcattggaagataaactcaaaagggcaaaaagtttactacttcggactgtttgactcatcaatgcccgatttgaatttcgacaatccacaagtgatgaacgaaatcaagagaataatcgatttctggataacagttggtgtggatggtttcagacttgatgcaccaaagcactacaaaggctgggattgggacgacggcatttcaggttcagcagcaatcgcgagggaaatagaaagttacatcaggagcaagttaggaaacgatgcgatagttgtcggggaagtgtacgatggaaatccatcggttctttcacaatttgcaccgatgccggcgttcaacttcacattcatgtatggaataacaggcaaccatgaggggaaagataacctgctgggagaaacaatttcatgggttaatggagcgagttattatctcaacgtaaaacatttcccgttcatagacaatcacgatttgaacagatggatatcgatacttatcgaccaaaagtatagtggaaacacacaagttggtacgaagcagtatattttaacaaatgcgctcttgctttccttaaacggtatgcctgttatttattatgggaatgaaataggcttgagaggatggaaatggggacaagacccgtgggatttgccggtgagagagccgatgcagtggtacgcaagtcaaagtggagctgggcagacatggtggacaaagcctgtctaccagcaaaaaggaatcacatttggaaatgcaaacgtcgatggtgcgatgtacgatgatccaaatgatggggtttcagtagaagagcagatgaatggttacacgataaataacttctttaaacaattcataaccctgaggaagacatatccggctctatcgaaaggttcgataacgatagaacgcgactggaagaacctgtacgttatcaaacgagtctacggaaatcaggaagtgcttgtattgataaacttagacccaacttggccgaacaattacacgttaccaggtggatacaggtgggtctggtatgcgttctttaatgggagtttgtttgaatttggcaataaaaacgaatcaccactgagccaagataccaactggacagtcaatccaaggcaagtgtatgtgtttgtgaaggactaa

SEQ ID NO: 100 - protein, 511 aa, Bacterial
MYTLFIRSFYDTNNDGVGDYNGVAQKVDYLKTLGVDTVWFLPFNKAKSYHGYDVEDYYDVEPDYGTYAQLENMIKTLNQNGIRVVMDLVVNHTSDTHSWFLDAVENTTNSKYWSYYIMTLENRDGWNHWHWKINSKGQKVYYFGLFDSSMPDLNFDNPQVMNEIKRIIDFWITVGVDGFRLDAPKHYKGWDWDDGISGSAAIAREIESYIRSKLGNDAIVVGEVYDGNPSVLSQFAPMPAFNFTFMYGITGNHEGKDNLLGETISWVNGASYYLNVKHFPFIDNHDLNRWISILIDQKYSGNTQVGTKQYILTNALLLSLNGMPVIYYGNEIGLRGWKWGQDPWDLPVREPMQWYASQSGAGQTWWTKPVYQQKGITFGNANVDGAMYDDPNDGVSVEEQMNGYTINNFFKQFITLRKTYPALSKGSITIERDWKNLYVIKRVYGNQEVLVLINLDPTWPNNYTLPGGYRWVWYAFFNGSLFEFGNKNESPLSQDTNWTVNPRQVYVFVKD

SEQ ID NO: 101 - DNA, 2136 bp, Environmental
ttgcgattctttccaaagttaatatccccttttccgcaaaacaccagagagtggcagcgaagcgcagtatcaagagacactgaacaattacaaaggaaagtaataatgatcaatttgaaaaaaaacaccattagcgccctggtcgcaggtatggtattaggctttgcatccaacgcaatggcggttcctagaaccgcttttgtacacctctttgaatggaaatgggaagatgttgcacaggagtgtgaaacatttctcggacctaaaggctttgccgcagtgcaagtctctccgccaactaaatctcacaacacggatgcatggtggggccgttatcaacccgttagttatgcttttgaaggacgcagcggtaatcgcagccaatttaaaaatatggtgcaacgttgtaaagctgtaggcgtcgatatatacgtagatgcagtgattaaccacatggcagcctacgacagaaatttccctgatgtaccctatagcagtaatgactttaactcctgtacaggagatattgactataataaccgttggcaaacacagcattgtgatttagtcggtcttaatgatctaaaaacaggatctgactacgtccgccaaaaaatagcggattatatgaacgacgcaatcagtatgggtgtagctggtttccgtattgatgcagccaaacatataccagcaggtgatatagctgccattaaaggtaaattaaatggtaatccatacatcttccaagaggtaattggtgcatccggcgaacctgttcgaccgactgaatacacctttatcggtggtgtcacggaatttcaatttgctcgaaaattgggtccagccttccgcaatagtaatattgcttggttaaaagacattggcagtcaaatggaattatccagtgctgatgccgtaacatttgtaacgaatcatgatgaagagcgtcataacccgaatggtcctatttggcacggcgttcaaggtaatggttatgcattagcaaatattttcaccttagcttacccttacggctatccaaaaatcatgtcaggatacttcttccacggtgactttaacgcagctccaccaagcagtggtatacacacaggaaatgcgtgtggttttgatggcggagactgggtatgcgaacacaaatggcgcggtattgctaacatggttgccttccgcaactatacagcaagcgaatggcgtatcagtaattggtggcaaaacagtaacgaccaaattgcttttggtcgcggtggtttaggttttgttgttattaataaacgtgctaatggtagcattaatcaaagttttgatacgggaatgcctgatggccaatactgtaacataatagaagctaactttgatgaaagcaccggccaatgtagtgcagctacagattccaacggtcaagccgttattaccgtcagtggtgggcaagctaactttaatgtagcaggcgatcatgctgctgcaattcatgttggcgcaaaaattggtgatcaatgtagtggtgatgattgcccatgtacaggatccgattgtaataatgatcctaaacctgattttgcagtaccagcaacatcaatttgtacatcagaaaatttacctacgctatattactggggagcacagcctacagatagcttagcgaatgcagcttggccaggtgtcgcaatgcaaacaaatggcgactttaagtgtcatgatttaggtgtcgaactaaccaaaattaacgccatctttagtgacaatggtgcaaataaaacagctgatctaactgttactggtgcaggttgttataaagacgggacttggagcaccttacaaaattgtggctttgaaattaccggtgcacaaaccaatccagtcggtggcgacgaagtctggtacttccgaggtactgctaatgactggggtaaagcacaattagattatgacgcaactagcggtttgtattacacaatacaaagctttaatggtgaagaagcacctgcgcgttttaaaattgataatggtagttggactgaagcttatccaacagctgattaccaagttacagataacaattcataccgcattaactttaatagcgatagcaaagcgattacagtaaacgcacaataa

SEQ ID NO: 102 - protein, 711 aa, Environmental
MRFFPKLISPFPQNTREWQRSAVSRDTEQLQRKVIMINLKKNTISALVAGMVLGFASNAMAVPRTAFVHLFEWKWEDVAQECETFLGPKGFAAVQVSPPTKSHNTDAWWGRYQPVSYAFEGRSGNRSQFKNMVQRCKAVGVDIYVDAVINHMAAYDRNFPDVPYSSNDFNSCTGDIDYNNRWQTQHCDLVGLNDLKTGSDYVRQKIADYMNDAISMGVAGFRIDAAKHIPAGDIAAIKGKLNGNPYIFQEVIGASGEPVRPTEYTFIGGVTEFQFARKLGPAFRNSNIAWLKDIGSQMELSSADAVTFVTNHDEERHNPNGPIWHGVQGNGYALANIFTLAYPYGYPKIMSGYFFHGDFNAAPPSSGIHTGNACGFDGGDWVCEHKWRGIANMVAFRNYTASEWRISNWWQNSNDQIAFGRGGLGFVVINKRANGSINQSFDTGMPDGQYCNIIEANFDESTGQCSAATDSNGQAVITVSGGQANFNVAGDHAAAIHVGAKIGDQCSGDDCPCTGSDCNNDPKPDFAVPATSICTSENLPTLYYWGAQPTDSLANAAWPGVAMQTNGDFKCHDLGVELTKINAIFSDNGANKTADLTVTGAGCYKDGTWSTLQNCGFEITGAQTNPVGGDEVWYFRGTANDWGKAQLDYDATSGLYYTIQSFNGEEAPARFKIDNGSWTEAYPTADYQVTDNNSYRINFNSDSKAITVNAQ

SEQ ID NO: 103 - DNA, 1650 bp, Environmental
gtgctaacgtttcaccgcatcattcgaaaaggatggatgttcctgctcgcgtttttgctcactgcctcgctgttctgcccaacaggacagcccgccaaggctgccgcaccgtttaacggcaccatgatgcagtattttgaatggtacttgccggatgatggcacgttatggaccaaagtggccaatgaagccaacaacttatccagccttggcatcaccgctctttggctgccgcccgcttacaaaggaacaagccgcagcgacgtagggtacggagtatacgacttgtatgacctcggcgaattcaatcaaaaagggaccgtccgcacaaaatacggaacaaaagctcaatatcttcaagccattcaagccgcccacgccgctggaatgcaagtgtacgccgatgtcgtgttcgaccataaaggcggcgccgacggcacggaatgggtggacgccgtcgaagtcaatccgtccgaccgcaaccaagaaatctcgggcacctatcaaatccaagcatggacgaaatttgattttcccgggcggggcaacacctactccagctttaagtggcgctggtaccattttgacggcgttgattgggacgaaagccgaaaattgagccgcatttacaaattccgcggcatcggcaaagcgtgggattgggaagtagacacggaaaacggaaactatgactacttaatgtatgccgaccttgatatggatcatcccgaagtcgtgaccgagctgaaaaactggggggaatggtatgtcaacacaacgaacattgatgggttccggcttgatgccgtcaagcatattaagttcagtttttttcctgattggttgtcgtatgtgcgttctcagactggcaagccgctatttaccgtcggggaatattggagctatgacatcaacaagttgcacaattacattacgaaaacaaacggaacgatgtctttgtttgatgccccgttacacaacaaattttataccgcttccaaatcagggggcgcatttgatatgcgcacgttaatgaccaatactctcatgaaagatcaaccgacattggccgtcaccttcgttgataatcatgacaccgaacccggccaagcgctgcagtcatgggtcgacccatggttcaaaccgttggcttacgcctttattctaactcggcaggaaggatacccgtgcgtcttttatggtgactattatggcattccacaatataacattccttcgctgaaaagcaaaatcgatccgctcctcatcgcgcgcagggattatgcttacggaacgcaacatgattatcttgatcactccgacatcatcgggtggacaagggaaggggtcactgaaaaaccaggatccgggctggccgcactgatcaccgatgggccgggaggaagcaaatggatgtacgttggcaaacaacacgctggaaaagtgttctatgaccttaccggcaaccggagtgacaccgtcaccatcaacagtgatggatggggggaattcaaagtcaatggcggttcggtttcggtttgggttcctagaaaaacgaccgtttctaccatcgctcggccgatcacaacccgaccgtggactggtgaattcgtccgttggaccgaaccacggttggtggcatggccttga

SEQ ID NO: 104 - protein, 549 aa, Environmental
VLTFHRIIRKGWMFLLAFLLTASLFCPTGQPAKAAAPFNGTMMQYFEWYLPDDGTLWTKVANEANNLSSLGITALWLPPAYKGTSRSDVGYGVYDLYDLGEFNQKGTVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPEVVTELKNWGEWYVNTTNIDGFRLDAVKHIKFSFFPDWLSYVRSQTGKPLFTVGEYWSYDINKLHNYITKTNGTMSLFDAPLHNKFYTASKSGGAFDMRTLMTNTLMKDQPTLAVTFVDNHDTEPGQALQSWVDPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTINSDGWGEFKVNGGSVSVWVPRKTTVSTIARPITTRPWTGEFVRWTEPRLVAWP

SEQ ID NO: 105 - DNA, 1650 bp, Environmental
atgtccctattcaaaaaaatctttccgtggattgtatctctacttcttttgttttcgtttattgctcctttttccattcaaacagaaaaagtccgcgctggaagtgttccagtgaatggaacgatgatgcaatatttcgaatggtaccttccagacgatggaacactatggacgaaagtagcaaataacgcccaatctttagcgaatcttggcattactgccctttggcttccccctgcctataaaggaacaagcagcagtgacgttggatatggcgtttatgatttatatgacctaggagagtttaatcaaaaaggaactgtccgaacaaaatacggaacaaaaacacaatatatccaagcaatccaagcggcgcatacagcaggaatgcaagtatatgcagatgtcgtctttaaccataaagccggtgcagatgggacagaactagtggatgcagtagaagtaaacccttctgaccgcaatcaagaaatatcaggaacatatcaaatccaagcgtggacaaaatttgattttcctggtcgtggaaacacctattctagttttaaatggcgttggtatcatttcgatggaacggactgggatgagagtagaaaactaaatcgtatttacaaattccgcggcacgggaaaagcatgggattgggaagtagatacagaaaatgggaattatgactatctcatgtatgcagatttggatatggatcatccagaggttgtatctgaactaaaaaattggggaaagtggtatgtaaccacaaccaatatcgacggattccgtctggatgcagtgaagcatattaaatatagctttttcccagactggctatcgtatgtacgaacccaaacacaaaagcctctttttgccgttggcgaattttggagctatgacattaacaagctacacaactatattacaaagacgaacggctctatgtccctattcgatgccccgctgcataacaatttttatatagcatcgaaatcaggtggctattttgatatgcgcacattactcaacaacacattgatgaaagatcaaccaacactatcggtcacattagtagacaatcacgatactgagccagggcaatctttgcagtcgtgggtcgagccgtggtttaaaccgttagcttacgcatttatcttgacccgccaagaaggttatccgtgcatcttttatggagattactatggtattccaaaatacaacattcctgcgctgaaaagcaaacttgatccgctgttaattgctcgaagagattatgcctacggaacacagcacgactatattgacaatgcagatattatcggctggacgcgggaaggagtagctgaaaaagcaaattcgggacttgctgcactcattaccgacggacctggcggaagcaaatggatgtatgttggcaaacaacacgctggcaaaacgttttatgatctaaccggcaatcgaagtgatacagtgacaatcaacgctgatggatggggagaatttaaagtcaatggagggtctgtatccatatgggttccaaaaacatcaaccacttcccaaatcacatttactgtaaataatgccacaaccgtttggggacaaaatgtatacgttgtcgggaatatttcgcagctgggcaac

SEQ ID NO: 106 - protein, 550 aa, Environmental
MSLFKKIFPWIVSLLLLFSFIAPFSIQTEKVRAGSVPVNGTMMQYFEWYLPDDGTLWTKVANNAQSLANLGITALWLPPAYKGTSSSDVGYGVYDLYDLGEFNQKGTVRTKYGTKTQYIQAIQAAHTAGMQVYADVVFNHKAGADGTELVDAVEVNPSDRNQEISGTYQIQAWTKFDFPGRGNTYSSFKWRWYHFDGTDWDESRKLNRIYKFRGTGKAWDWEVDTENGNYDYLMYADLDMDHPEVVSELKNWGKWYVTTTNIDGFRLDAVKHIKYSFFPDWLSYVRTQTQKPLFAVGEFWSYDINKLHNYITKTNGSMSLFDAPLHNNFYIASKSGGYFDMRTLLNNTLMKDQPTLSVTLVDNHDTEPGQSLQSWVEPWFKPLAYAFILTRQEGYPCIFYGDYYGIPKYNIPALKSKLDPLLIARRDYAYGTQHDYIDNADIIGWTREGVAEKANSGLAALITDGPGGSKWMYVGKQHAGKTFYDLTGNRSDTVTINADGWGEFKVNGGSVSIWVPKTSTTSQITFTVNNATTVWGQNVYVVGNISQLGN

SEQ ID NO: 107 - DNA, 1509 bp, Environmental
atggacagcctcgacgcgccggagcagaagccctgggtgaaggatggcaggctctccgcgtacctggatacagggacagggaccgtggtcgctcccgaggcacctgcgcccccgccgcccccggccgaggaagtccggcccgtggacaagtggaaaaacgatatcatctatttcgtcctcaccgaccgtttccaggatggcgacaagaccaacaacatggacgtggtcccgacggacatgaaaaaatatcatggcggcgacatccaggggctcatcgacaagctcgactatatcaaggagaccggttcgacggccatctggctcacgccccctatgaaggggcagacccacttcttcgagaccgacaattaccatggttactggcccattgacttctatgacacggacccccatgtgggcaccatgcagaaatttgaggagcttatcgagaaagcccatgagaaagggctgaagatcgtgctcgatattcccctgaaccacacggcctgggagcatcccttctacaaggacgacagcaagaaggactggttccaccatataggagatgtgaaggactgggaagatccctactgggctgaaaacggctccatattcggtcttcctgacctggcgcaggaaaaccctgccgtggaaaagtacctcatcgacgtggccaagttctgggtagacaagggtattgacggcttcaggcttgacgccgtgaagaacgtgcccctcaacttctgggcgaagtttgaccgggcgattcacgattatgcgggcaaggacttcctcctcgtcggggaatactttgacggaaacccggcgaaagtcgcgaactaccagagagaggacatgagctcactcttcgattacccgctctactggaccctgaaggacaccttcgccaaggacgggagcatgcgcaacctggcggcgaagcttgatgagtgcgacaggaattatcccgacccgggcctcatgtcggttttccttgataaccacgacacgccgaggttcctcaccgaggccaacggcaacaaggataagctcaaactggccctcgccttcgcgatgaccatcaaccgcatgcctaccatttattatggcaccgaggttgccatggaaggcaactgcgatatcatgggcgccgtagataaccggagggacatgcagtgggacaaggatcctgacatgttcaaatacttcaagactctcaccactgcccgcaatgagcatgaatccctcagggaaggaaagaagctcgagatgtggcaggatgacaaagtctacgcgtacgggaggcagaccccgaaggacgagtctatcgtggtgcttaacaacggctatgatacgcaggaacgggacataccgctccgccccgagagcggcatcaagaacggcacggtgctgaaggatgtcatcaccggcgaaaccgtgacggtacagaacggaaaaatccatgcgaaatgcggcggcaaacaggcgcggatctacgtgcccgcgtag

SEQ ID NO: 108 - protein, 502 aa, Environmental
MDSLDAPEQKPWVKDGRLSAYLDTGTGTVVAPEAPAPPPPPAEEVRPVDKWKNDIIYFVLTDRFQDGDKTNNMDVVPTDMKKYHGGDIQGLIDKLDYIKETGSTAIWLTPPMKGQTHFFETDNYHGYWPIDFYDTDPHVGTMQKFEELIEKAHEKGLKIVLDIPLNHTAWEHPFYKDDSKKDWFHHIGDVKDWEDPYWAENGSIFGLPDLAQENPAVEKYLIDVAKFWVDKGIDGFRLDAVKNVPLNFWAKFDRAIHDYAGKDFLLVGEYFDGNPAKVANYQREDMSSLFDYPLYWTLKDTFAKDGSMRNLAAKLDECDRNYPDPGLMSVFLDNHDTPRFLTEANGNKDKLKLALAFAMTINRMPTIYYGTEVAMEGNCDIMGAVDNRRDMQWDKDPDMFKYFKTLTTARNEHESLREGKKLEMWQDDKVYAYGRQTPKDESIVVLNNGYDTQERDIPLRPESGIKNGTVLKDVITGETVTVQNGKIHAKCGGKQARIYVPA

SEQ ID NO: 109 - DNA, 1374 bp, Environmental
atggcaagaaaaacgctggccatatttttcgtacttctagtgcttcttagtctctcggcagttccggcaaaggcagaaactctagagaatggtggagttataatgcaggctttctattgggatgttcctggaggaggaatctggtgggacacaatagctcaaaagatacccgaatgggcaagtgcaggaatctcagcgatatggattccaccagcgagtaagggcatgagcggtggttattccatgggctacgatccctacgatttctttgacctcggcgagtactatcagaaggggacagttgagacgcgcttcggctcaaaggaagaactggtgaacatgataaacaccgcacactcctacggcataaaggtgatagcggacatagtcataaaccaccgcgccggtggagaccttgagtggaaccccttcgtgaacgactatacctggacagacttctcaaaagtcgcctccggtaaatatacggccaactaccttgacttccacccaaacgagcttcactgttgtgatgaaggtacctttggaggataccctgatatatgtcacgacaaaagctgggaccagtactggctctgggcgagcagcgaaagctacgctgcctacctcaggagcataggggttgacgcctggcgtttcgactacgtcaagggctacggagcatgggttgttaacgactggctcagctggtggggaggctgggccgttggagagtactgggacacgaacgttgatgcactcctcaactgggcatacagcagcggcgccaaggtctttgacttcccgctctactacaagatggacgaagccttcgacaacaccaacatcccggcattagtggatgcactcagatacggccagacagtggtcagccgcgatcccttcaaggcggtaactttcgttgccaaccacgatacagatataatctggaacaagtatccggcttatgcattcatccttacctatgagggacagcctgttatattctaccgcgactacgaggagtggctcaacaaggataagcttaacaacctcatctggatacacgatcaccttgctggagggagtactgacattgtttactacgacagcgacgagcttatctttgtgagaaacggctatggcaccaaaccaggactgataacctatatcaacctcggctcaagcaaagttggaaggtgggtctacgttccaaagttcgccggttcatgcatccacgagtacaccggcaacctcggcggttggatagacaagtacgtctcctccagcggctgggtctatcttgaggccccagcccacgacccggcgaacggctactacggctactctgtctggagctactgcggtgtgggttga

SEQ ID NO: 110 - protein, 457 aa, Environmental
MARKTLAIFFVLLVLLSLSAVPAKAETLENGGVIMQAFYWDVPGGGIWWDTIAQKIPEWASAGISAIWIPPASKGMSGGYSMGYDPYDFFDLGEYYQKGTVETRFGSKEELVNMINTAHSYGIKVIADIVINHRAGGDLEWNPFVNDYTWTDFSKVASGKYTANYLDFHPNELHCCDEGTFGGYPDICHDKSWDQYWLWASSESYAAYLRSIGVDAWRFDYVKGYGAWVVNDWLSWWGGWAVGEYWDTNVDALLNWAYSSGAKVFDFPLYYKMDEAFDNTNIPALVDALRYGQTVVSRDPFKAVTFVANHDTDIIWNKYPAYAFILTYEGQPVIFYRDYEEWLNKDKLNNLIWIHDHLAGGSTDIVYYDSDELIFVRNGYGTKPGLITYINLGSSKVGRWVYVPKFAGSCIHEYTGNLGGWIDKYVSSSGWVYLEAPAHDPANGYYGYSVWSYCGVG

SEQ ID NO: 111 - DNA, 1416 bp, Environmental
atgcccgcgttcaaatctaaggtgatgcacatgaagttgaagtaccttgctttagttttgttggctgtggcttcgataggcctcctctcgactccagtgggtgctgccaagtactccgaactcgaagagggcggtgttataatgcaggccttctactgggacgtccctaccggtgggatctggtgggacaccataagacagaaaatcccggagtggtacgacgctggaatctcggcgatatggattcctccagctagcaaaggtatgggtggtgcatactccatgggttatgacccctacgatttctttgacctcggcgagtactatcagaagggaacagttgagacgcgcttcggctcaaaggaggaactggtgaacatgataaacaccgcacactcctatggcataaaggtgatagcggacatagtcataaaccaccgcgccggcggcgacctggagtggaacccctttgtaaacaactatacttggacagacttctccaaggtcgcctccggtaaatacacggccaactaccttgacttccacccaaacgaggtcaagtgctgcgatgagggtacatttggtgactttccggacatcgcccacgagaagagctgggatcagtactggctctgggcaagcaatgagagctacgccgcctatctccggagcatagggatcgatgcatggcgtttcgactacgtcaaaggttacggagcgtgggttgttaacgactggctcagctggtggggaggttgggccgttggagagtactgggacaccaacgttgatgcactccttaactgggcatacaacagcggtgccaaggtctttgacttcccgctctactacaagatggacgaagcctttgacaacaccaacatccccgctttggtttacgccctccagaacggaggaacagtcgtttcccgcgatcccttcaaggcagtaactttcgttgccaaccacgataccgatataatctggaacaagtatccggcttatgcgttcatccttacctatgagggacagcctgttatattctaccgcgactacgaggagtggctcaacaaggataagcttaacaaccttatctggatacacgagcaccttgccggaggaagtaccaagatcctctactacgataacgatgagctaatattcatgagggagggctacgggagcaagccgggcctcataacctacataaacctcggaaacgactgggccgagcgctgggtgaacgtcggctcaaagtttgccggctacacaatccatgaatacacaggcaatctcggtggctgggttgacaggtgggttcagtacgacggatgggttaaactgacggcacctcctcacgatccagccaacggatattacggctactcagtctggagctacgcaggcgtcggatga

SEQ ID NO: 112 - protein, 471 aa, Environmental
MPAFKSKVMHMKLKYLALVLLAVASIGLLSTPVGAAKYSELEEGGVIMQAFYWDVPTGGIWWDTIRQKIPEWYDAGISAIWIPPASKGMGGAYSMGYDPYDFFDLGEYYQKGTVETRFGSKEELVNMINTAHSYGIKVIADIVINHRAGGDLEWNPFVNNYTWTDFSKVASGKYTANYLDFHPNEVKCCDEGTFGDFPDIAHEKSWDQYWLWASNESYAAYLRSIGIDAWRFDYVKGYGAWVVNDWLSWWGGWAVGEYWDTNVDALLNWAYNSGAKVFDFPLYYKMDEAFDNTNIPALVYALQNGGTVVSRDPFKAVTFVANHDTDIIWNKYPAYAFILTYEGQPVIFYRDYEEWLNKDKLNNLIWIHEHLAGGSTKILYYDNDELIFMREGYGSKPGLITYINLGNDWAERWVNVGSKFAGYTIHEYTGNLGGWVDRWVQYDGWVKLTAPPHDPANGYYGYSVWSYAGVG

SEQ ID NO: 113 - DNA, 1539 bp, Environmental
atgaaacaacaaaaacggctttacgcccgattgctgacgctgttatttgcgctcatcttcttgctgcctcattctgcagcagcggcggcaaatcttaatgggacgctgatgcagtattttgaatggtacatgcccaatgacggccaacattggaagcgcttgcaaaacgactcggcatatttggctgaacacggtattactgccgtctggattcccccggcatataagggaacgagccaagcggatgtgggctacggtgcttacgacctttatgatttaggggagtttcatcaaaaagggacggttcggacaaagtacggcacaaaaggagagctgcaatctgcgatcaaaagtcttcattcccgcgacattaacgtttacggggatgtggtcatcaaccacaaaggcggcgctgatgcgaccgaagatgtaaccgcggttgaagtcgatcccgctgaccgcaaccgcgtaatttcaggagaacaccgaattaaagcctggacacattttcattttccggggcgcggcagcacatacagcgattttaaatggcattggtaccattttgacggaaccgattgggacgagtcccgaaagctgaaccgcatctataagtttcaaggaaaggcttgggattgggaagtttccaatgaaaacggcaactatgattatttgatgtatgccgacatcgattatgaccatcctgatgtcgcagcagaaattaagagatggggcacttggtatgccaatgaactgcaattggacggtttccgtcttgatgctgtcaaacacattaaattttcttttttgcgggattgggttaatcatgtcagggaaaaaacggggaaggaaatgtttacggtagctgaatattggcagaatgacttgggcgcgctggaaaactatttgaacaaaacaaattttaatcattcagtgtttgacgtgccgcttcattatcagttccatgctgcatcgacacagggaggcggctatgatatgaggaaattgctgaacggtacggtcgtttccaagcatccgttgaaagcggttacatttgtcgataaccatgatacacagccggggcaatcgcttgagtcgactgtccaaacatggtttaagccgcttgcttacgctttcattctcacaagggaatctggataccctcaggttttctacggggatatgtacgggacgaaaggagactcccagcgcgaaattcctgccttgaaacacaaaattgaaccgatcttaaaagcgagaaaacagtatgcgtacggagcacagcatgattatttcgaccaccatgacattgtcggctggacaagggaaggcgacagctcggttgcaaattcaggtttggcggcattaataacagacggacccggtggggcaaagcgaatgtatgtcggccggcaaaacgccggtgagacatggcatgacattaccggaaaccgttcggagccggttgtcatcaattcggaaggctggggagagtttcacgtaaacggcgggtcggtttcaatttatgttcaaagatag

SEQ ID NO: 114 - protein, 512 aa, Environmental
MKQQKRLYARLLTLLFALIFLLPHSAAAAANLNGTLMQYFEWYMPNDGQHWKRLQNDSAYLAEHGITAVWIPPAYKGTSQADVGYGAYDLYDLGEFHQKGTVRTKYGTKGELQSAIKSLHSRDINVYGDVVINHKGGADATEDVTAVEVDPADRNRVISGEHRIKAWTHFHFPGRGSTYSDFKWHWYHFDGTDWDESRKLNRIYKFQGKAWDWEVSNENGNYDYLMYADIDYDHPDVAAEIKRWGTWYANELQLDGFRLDAVKHIKFSFLRDWVNHVREKTGKEMFTVAEYWQNDLGALENYLNKTNFNHSVFDVPLHYQFHAASTQGGGYDMRKLLNGTVVSKHPLKAVTFVDNHDTQPGQSLESTVQTWFKPLAYAFILTRESGYPQVFYGDMYGTKGDSQREIPALKHKIEPILKARKQYAYGAQHDYFDHHDIVGWTREGDSSVANSGLAALITDGPGGAKRMYVGRQNAGETWHDITGNRSEPVVINSEGWGEFHVNGGSVSIYVQR

SEQ ID NO: 115 - DNA, 1338 bp, Eukaryote
atggcgaagtactccgagctggagcagggcggagtcataatgcaggccttctactgggacgttccggagggaggaatctggtgggacacaatacggcagaagatccctgaatggtacgatgcaggcatatccgccatctggatacccccggcgagcaagggcatgggcggggcctactcgatgggctacgacccctacgattacttcgatctgggcgagttttaccagaagggaaccgttgagacccgcttcggctccaaggaagagctcgtcaacatgatctccacggcccaccagtacggcatcaaggttatagcggacatagtgataaaccaccgcgcaggtggagacctcgaatggaacccatacgtcggcgactatacctggacggacttttctaaggtcgcctccgggaaatacaaggcccactacatggacttccatccaaacaactacagcacctcagacgagggaaccttcggtggcttcccagacattgatcacctcgtgcccttcaaccagtactggctgtgggcgagcaacgagagctacgccgcctacctcaggagcatagggatcgatgcgtggcgctttgactacgttaagggctacggcgcgtgggtcgtcaaggactggctgagtcagtggggcggctgggccgtcggcgagtactgggacaccaacgtcgatgcgctcctcaactgggcctacagcagcggcgccaaggtcttcgacttcccgctctactacaagatggacgaggcctttgacaacaagaacattcccgccctcgtttacgccatccagaacggtgaaaccgtcgtcagcagggatcccttcaaggccgttaccttcgtggctaaccacgatacgaacataatctggaacaagtaccctgcctatgccttcatcctgacctacgaaggtcagcccgtcatcttctaccgcgactacgaggagtggctcaacaaggacaaactcaacaacctcatatggattcacgagcacctggcagggggaagcaccaagatcctctactacgacgacgatgagctcatcttcatgagggaaggctacggcgacaggcccgggcttataacctacatcaacctcggtagcgactgggcggagagatgggtgaacgttggctcaaagttcgcgggctatacaatccacgaatacaccggaaacctcggcggctgggtcgacaggtacgtccagtacgacggctgggtcaagcttaccgctccgccacacgatccggcaaacggctattacggctactcggtctggagctacgccggagttggaagatctcatcaccatcaccatcactaa

SEQ ID NO: 116 - protein, 445 aa, Eukaryote
MAKYSELEQGGVIMQAFYWDVPEGGIWWDTIRQKIPEWYDAGISAIWIPPASKGMGGAYSMGYDPYDYFDLGEFYQKGTVETRFGSKEELVNMISTAHQYGIKVIADIVINHRAGGDLEWNPYVGDYTWTDFSKVASGKYKAHYMDFHPNNYSTSDEGTFGGFPDIDHLVPFNQYWLWASNESYAAYLRSIGIDAWRFDYVKGYGAWVVKDWLSQWGGWAVGEYWDTNVDALLNWAYSSGAKVFDFPLYYKMDEAFDNKNIPALVYAIQNGETVVSRDPFKAVTFVANHDTNIIWNKYPAYAFILTYEGQPVIFYRDYEEWLNKDKLNNLIWIHEHLAGGSTKILYYDDDELIFMREGYGDRPGLITYINLGSDWAERWVNVGSKFAGYTIHEYTGNLGGWVDRYVQYDGWVKLTAPPHDPANGYYGYSVWSYAGVGRSHHHHHH

SEQ ID NO: 117 - DNA, 1476 bp, Environmental
atgcgagtgttcctggttgtgccaaagctgagccgcccatttcaggcagagtcacaacaacaagacagggacataacaatgaaacacacagcgggaatgctggcgatcgcaggtatgctgatcgcccccttggcgcatgccgatgtcatactgcacgccttcaactggaaatacagtgaagtcaccgccaaggccgatctcatcaaggctgccggctacaagcaggtgctcatctcaccgcctctgaagtcctcgggcaacgagtggtgggctcgttaccagccccaggatctgcgcctggtcgacaccccccttggcaacaagcaggatctggagcagctgatcgccgcgatgcagacccggggcattgccgtctacgcggacgtggtgctcaaccacatggccaacgaaagctggaagcgcagcgacctcaactaccccggcagcgagctgctgcaaagctacgccggcaatccggcctactttgaacgccagaagctctttggcgatctggggcagaacttcctcgccggccaggattttcatccggaggggtgcatcaccgactggaacaatccgggccatgtccagtactggcgactgtgcggcggggcgggtgacaaggggctgccggatctggaccccaacaactgggtggtgaaccagcaacaggcttacctgcaggcgctcaaggggatggggatcaagggttttcgggtcgatgcggtcaagcacatgagcgattaccagatcaacgccgtgttcacccccgagatcaaacaggggatgcacgtctttggcgaggtgatcaccacggggggcgccggcaacagcgactatgagaacttcctcaaaccctacctcgacagcagcggccagggggcctacgacttcccgctcttcgcctccctgcgtggagcgctgggctacggcggcagcatgaacctgctggccgatcccggtgcctatggtcaggcgctgccgggtagccgcgccgtcaccttcgccatcacccacgacatccccaccaacgacggtttccgctaccagatcctcaaccagaccgacgagagactggcctatgcctacctgctcggtcgcgatggcggttcgcctctggtctactccgatcacggtgaaaccagggacaaggacggattgcgctggcaggactactatctgcgcaccgatctcaaagggatgatccgcttccataacacagtgcagggtcaaccgatgcagctcatcggcagtaacgactgcttcgtgctgttcaagcgtggcaagcagggcgtggtcggcatcaacaagtgcgactacgagcaggagtactggctcgataccgccagattcgagatgaactggtatcgcaactaccgggatgtgctcgaccagaatgccgtggtcaacgtgcagagccagtgggtaaggctgaccatcccggcccgcggcgccagaatgtggctgcaggagtga

SEQ ID NO: 118 - protein, 491 aa, Environmental
MRVFLVVPKLSRPFQAESQQQDRDITMKHTAGMLAIAGMLIAPLAHADVILHAFNWKYSEVTAKADLIKAAGYKQVLISPPLKSSGNEWWARYQPQDLRLVDTPLGNKQDLEQLIAAMQTRGIAVYADVVLNHMANESWKRSDLNYPGSELLQSYAGNPAYFERQKLFGDLGQNFLAGQDFHPEGCITDWNNPGHVQYWRLCGGAGDKGLPDLDPNNWVVNQQQAYLQALKGMGIKGFRVDAVKHMSDYQINAVFTPEIKQGMHVFGEVITTGGAGNSDYENFLKPYLDSSGQGAYDFPLFASLRGALGYGGSMNLLADPGAYGQALPGSRAVTFAITHDIPTNDGFRYQILNQTDERLAYAYLLGRDGGSPLVYSDHGETRDKDGLRWQDYYLRTDLKGMIRFHNTVQGQPMQLIGSNDCFVLFKRGKQGVVGINKCDYEQEYWLDTARFEMNWYRNYRDVLDQNAVVNVQSQWVRLTIPARGARMWLQE

SEQ ID NO: 119 - DNA, 1695 bp, Bacterial
atgcaaacgtttgcattcttattttactcaaagaaaggatgggtgtgcatgaattatttgaaaaaagtgtggttgtattacgctatcgtcgctaccttaatcatttcctttcttacacctttttcaacagcacaagctaatactgcacctgttaacggaacaatgatgcaatatttcgaatgggacttacctaatgatgggacgctttggacgaaagtaaaaaatgaagctaccaatctttcttcactaggtatcacagcactatggctccctccagcatataaaggaacgagccaaagcgatgtcggatacggtgtttacgatttatatgaccttggggaatttaatcaaaaagggacgatccgaacgaaatacggaacaaaaacacaatatattcaagccattcaaactgcccaagccgcagggatgcaagtatatgcggatgttgtatttaatcataaggcaggggctgacagtacagaatttgtcgatgcagttgaggtaaacccttctaatcgaaatcaagaaacatctggcacatatcaaattcaagcatggacaaaatttgattttcctggtcgtggaaacacatactccagcttcaaatggcgctggtaccattttgatggtacggattgggacgaaagtcgtaaattaaatcgtatttacaaattccgcggtacaggaaaagcgtgggactgggaagtcgatacagaaaacggaaactatgattatttaatgttcgctgatttagatatggatcaccctgaggttgtgacagaattaaaaaactggggaacgtggtacgtcaatactacaaatatcgatggattccgcttagatgccgtaaaacatattaaatacagctttttccctgactggctaacatatgtacgtaatcaaacaggaaaaaatttatttgccgttggggaattttggagctatgacgtcaataagctgcataattacattacaaaaacaaatgggtcgatgtcattatttgatgcacccttgcataacaacttttataccgcttccaaatcgagtggatattttgacatgcgttatttattgaataatacattaatgaaagatcaaccttcactcgctgtaacacttgtcgataaccacgacacgcaaccagggcaatctttacagtcatgggtcgaaccttggtttaaacagcttgcttacgcctttattttaacaagacaagaagggtatccttgcgtattttacggtgattattatggaatccctaaatacaatatcccggggttaaaaagtaaaatcgacccgcttttaattgctcgtcgtgattacgcttatggaacacaacgtgattacattgatcatcaagacattatcggatggacacgagaaggcattgatgcaaaaccgaactctggactggcggctttaattaccgacggtcctggtggaagtaaatggatgtatgtcggtaaaaagcatgccgggaaagtattttatgatttaactggaaatcgaagtgacacagtaacgattaatgcggatggttggggagaatttaaagtaaacggaggatccgtctcaatttgggtggctaaaacgtcaaacgtcacatttacagtcaataacgccacaacaacaagcggacaaaacgtatatgttgtcggcaacattccagagctaggcaattgtcgcacgggttaa

SEQ ID NO: 120 - protein, 564 aa, Bacterial
MQTFAFLFYSKKGWVCMNYLKKVWLYYAIVATLIISFLTPFSTAQANTAPVNGTMMQYFEWDLPNDGTLWTKVKNEATNLSSLGITALWLPPAYKGTSQSDVGYGVYDLYDLGEFNQKGTIRTKYGTKTQYIQAIQTAQAAGMQVYADVVFNHKAGADSTEFVDAVEVNPSNRNQETSGTYQIQAWTKFDFPGRGNTYSSFKWRWYHFDGTDWDESRKLNRIYKFRGTGKAWDWEVDTENGNYDYLMFADLDMDHPEVVTELKNWGTWYVNTTNIDGFRLDAVKHIKYSFFPDWLTYVRNQTGKNLFAVGEFWSYDVNKLHNYITKTNGSMSLFDAPLHNNFYTASKSSGYFDMRYLLNNTLMKDQPSLAVTLVDNHDTQPGQSLQSWVEPWFKQLAYAFILTRQEGYPCVFYGDYYGIPKYNIPGLKSKIDPLLIARRDYAYGTQRDYIDHQDIIGWTREGIDAKPNSGLAALITDGPGGSKWMYVGKKHAGKVFYDLTGNRSDTVTINADGWGEFKVNGGSVSIWVAKTSNVTFTVNNATTTSGQNVYVVGNIPELGNCRTG

SEQ ID NO: 121 - DNA, 1556 bp, Environmental
atgctcgccctgtcgctcggcggctgcggcatcgacgcgggcccgacaggccctcgcgtcgtggagccgctgccgcagcgccccacgcttccgcaggagtaccgcgccagcggccacgcggccgccggcgacgtgttcgtgcacctgttcgagtggaagtggccggacatcgcggaggaatgcgagaacgtgctggggccggcgggctacgaggcggtgcaggtgtcgccgccgcaggagcacctggtgcagcagggggcgccgtggtggcagcggtaccagccggtgagctactcggtggcgctgagccgcagcggcacgggcgtggagttcagcaacatgatcagccggtgcaaggccgccggcgtggacatctacgtggacgccgtcatcaaccacatgacggccggtgcggggacggggagcaacggcaccgcctacaccaagtacaactaccccggcctgtacgcgcaggcggactttcacccgcagtgcgcggtgggcgactacaccagcgccgccaacgtgcaggactgcgaactgctggggctggctgacctgaacaccggcgcggccggcgtgcagcagaagatcgcggactacctggtctcgctggcgcggctgggcgtggcgggttttcgcatcgacgccgccaagcacatccagccggtggaactggacgccatcgtggaccgcgtgaaccagacgctggcggcggaggggcgcccgcttccctactggttcgccgaggtgatcgacaacggcggcgagggggtgcggcgcgagcactactacggcctgggatacggcaccggcggcgccgcggacatcacggagttccgctacaagggcgtgggcgacaagttcctgggcagcggcggccagcggctggtggacctgaagaacttctcggcggtgacgtggaacctgatgccgtcggacaaggccgtcgtctttctggagaaccacgatacgcagcgcggcggcggcatcggctaccgcgatggcacggcgttccggctggccaacgtgtggatgctggcgcagccgtacggctatccgtcggtgatgtccagctacgcctttgaccgcacctccccctttggccgcgacgccggcccgccctccgaggacggcgcgacgaaggacgtgacgtgcgcgcccacgctggagacggcggtgctgggcacctgggtgtgcgagcaccgcgaccccgtcattcagcggatggtgggctttcgccgcgcgatggcgggcacggacctgaaccgctggtgggacaacggcggcaacgccattgccttttcgcgcggggaccggggcttcgtcgccatcagccgcgagccgaaggtgaccatggcggccgtgcccagcggactgtcccccggcacctactgcgacgtgctgaccggcggcaaggtgggcaacgcctgcgcgggaaccagcgtgacggtcgactctcagggcgtggtgcagctgagcatcgtcgagaactcggctctggtgatccacctcggggccaagctgtaacggcgcgctggcggatgtgcggaggg

SEQ ID NO: 122 - protein, 517 aa, Environmental
MLALSLGGCGIDAGPTGPRVVEPLPQRPTLPQEYRASGHAAAGDVFVHLFEWKWPDIAEECENVLGPAGYEAVQVSPPQEHLVQQGAPWWQRYQPVSYSVALSRSGTGVEFSNMISRCKAAGVDIYVDAVINHMTAGAGTGSNGTAYTKYNYPGLYAQADFHPQCAVGDYTSAANVQDCELLGLADLNTGAAGVQQKIADYLVSLARLGVAGFRIDAAKHIQPVELDAIVDRVNQTLAAEGRPLPYWFAEVIDNGGEGVRREHYYGLGYGTGGAADITEFRYKGVGDKFLGSGGQRLVDLKNFSAVTWNLMPSDKAVVFLENHDTQRGGGIGYRDGTAFRLANVWMLAQPYGYPSVMSSYAFDRTSPFGRDAGPPSEDGATKDVTCAPTLETAVLGTWVCEHRDPVIQRMVGFRRAMAGTDLNRWWDNGGNAIAFSRGDRGFVAISREPKVTMAAVPSGLSPGTYCDVLTGGKVGNACAGTSVTVDSQGVVQLSIVENSALVIHLGAKLRRAGGCAE

SEQ ID NO: 123 - DNA, 1770 bp, Environmental
atgccccaggccattcgcactttttcacgttggacgttgttcggcttaatcggcgtttttctgcttggtctcgtcttttctgtcccaccccgggcaatccaggcccagacaaccccggcccgtaccgttatggttcacctcttcgagtggaaatggaccgacatcgctaaagaatgcgagaatttcctcggaccgaaaggctttgccgcaatccaggtatcgccgccccaggagcatgtccaggggtcgcaatggtggacccgctatcagccggtcagctacaagatcgagagccgctccggcacccgggccgagttcgccaatatggtctcgcgctgcaaagccgtcggggtcgatatctatgtcgatgccgtgatcaaccatatgacgactgtcggctccggcactggtatggctggatcgacctacaccagctacacctatccggggctgtatcagacccaggacttccaccactgcgggcgcaatggcaacgatgatatcagcagctacggcgatcgctgggaagtacaaaactgcgaactgctcaacctagccgacctcaacaccggcgctgagtatgtccggggtaaactcgccgcctatatgaacgatctgcgcggcctgggcgtcgccggatttcggatcgatgccgccaagcacatggataccaacgacatcaacaatatcgttggccgcctgcccaacgcgccctacatctaccaggaagtgatcgaccagggcggcgagccaattaccgccggcgaatacttccagaatggcgatgtgaccgagttcaagtacagccgcgagatctcgcgcatgttcaaaaccggccagctgacccatatgagccagttcggcactgcctggggcttcatgtccagcgacctggcagtagttttcaccgataaccacgacaaccagcgcggtcacggcggcgccggcgatgtcttgacctacaaagatggccagctgtacaccctgggcaatatcttcgagctagcctggccgtatggctacccacaggtcatgtcgagctacacgttcagcaacggcgaccaggggccgccatcgaccaatgtgtacgcaaccacaacgcctgattgtggcaacggccgctgggtctgtgagcaccgctggcgaggaatcgccaacatggtcgcgttccgcaactacaccgccccgaccttcagcaccagcaactggtggagcaacggcaacaaccagatcgctttcagccgcgggaccctgggctttgtggcgatcaatcgggaaggtggcagcctgaaccgcaccttccaaaccggcctgcccgtcggcacctactgcgatgtcattcacggcgatttcaatgccagcgccggcacctgttccggcccaactatcgctgtcaacggctccggacaggcaaccatcacggtcaacgcgatggacgcggtggcgatctacggcggagccaggctcgccactccggccagtgtcaacgtgacattcaacgaaaacgccacgaccacctgggggcagaatgtgtatatcgtcggcaacgtcgccgccctgggcagctggaacgcaggcagcgcggtcttactctcctccgctaactacccaatctggagcaagaccatcgccctgccagccaacaccgccattgagtacaagtacatcaaaaaggatggcgcgggcaatgtggtgtgggaaagcggcgccaaccgcgtctttaccacccccggcagcggcagtgccacgcgcaacgatacctggaaatag

SEQ ID NO: 124 - protein, 589 aa, Environmental
MPQAIRTFSRWTLFGLIGVFLLGLVFSVPPRAIQAQTTPARTVMVHLFEWKWTDIAKECENFLGPKGFAAIQVSPPQEHVQGSQWWTRYQPVSYKIESRSGTRAEFANMVSRCKAVGVDIYVDAVINHMTTVGSGTGMAGSTYTSYTYPGLYQTQDFHHCGRNGNDDISSYGDRWEVQNCELLNLADLNTGAEYVRGKLAAYMNDLRGLGVAGFRIDAAKHMDTNDINNIVGRLPNAPYIYQEVIDQGGEPITAGEYFQNGDVTEFKYSREISRMFKTGQLTHMSQFGTAWGFMSSDLAVVFTDNHDNQRGHGGAGDVLTYKDGQLYTLGNIFELAWPYGYPQVMSSYTFSNGDQGPPSTNVYATTTPDCGNGRWVCEHRWRGIANMVAFRNYTAPTFSTSNWWSNGNNQIAFSRGTLGFVAINREGGSLNRTFQTGLPVGTYCDVIHGDFNASAGTCSGPTIAVNGSGQATITVNAMDAVAIYGGARLATPASVNVTFNENATTTWGQNVYIVGNVAALGSWNAGSAVLLSSANYPIWSKTIALPANTAIEYKYIKKDGAGNVVWESGANRVFTTPGSGSATRNDTWK

SEQ ID NO: 125 - DNA, 1395 bp, Environmental
gtggtgcacatgaagttgaagtaccttgccttagttttgttggctgtggcttcgataggcctactctcgactccagtgggtgctgccaagtactccgaactcgaagagggcggtgttataatgcaggccttctactgggatgttcccggagggggaatctggtgggacaccataagacagaaaatcccggagtggtacgacgctggaatctcggcgatatggattcctccagctagcaaagggatgggcggtggttattccatgggctacgatccctacgatttctttgacctcggcgagtactatcagaagggaacagttgagacgcgcttcggctcaaaggaggaactggtgaacatgataaacaccgcacactcctatggcataaaggtgatagcggacatagtcataaaccaccgcgccggtggagaccttgagtggaacccctttgtaaacaactatacttggacagacttctccaaggtcgcctccggtaaatacacggccaactaccttgacttccacccaaacgaggtcaagtgctgcgatgagggtacatttggtgactttccggacatcgcccacgagaagagctgggatcagtactggctctgggcaagcaatgagagctacgccgcatatctccggagcatagggatcgatgcatggcgtttcgactacgtcaaaggttacggagcgtgggttgttaatgactggctcagctggtggggaggctgggccgttggagagtactgggacacgaacgttgatgcactccttaactgggcatacgacagcggtgccaaggtctttgacttcccgctctactacaagatggacgaagcctttgacaacaccaacatccccgctttggtttacgccctccagaacggaggaacagtcgtttcccgcgatcccttcaaggcagtaactttcgttgccaaccacgatacagatataatctggaacaagtatccggcttatgcgttcatccttacctatgagggacagcctgttatattttaccgcgactacgaggagtggctcaacaaggataagcttaacaaccttatctggatacacgagcaccttgccggaggaagtaccaagatcctctactacgataacgatgagctaatattcatgagggagggctacgggagcaagccgggcctcataacctacataaacctcggaaacgactgggccgagcgctgggtgaacgtcggctcaaagtttgccggctacacaatccatgaatacacaggcaatctcggtggctgggttgacaggtgggttcagtacgatggatgggttaaactgacggcacctcctcatgatccagccaacggatattacggctactcagtctggagctacgcaggcgtcggatga

SEQ ID NO: 126 - protein, 464 aa, Environmental
VVHMKLKYLALVLLAVASIGLLSTPVGAAKYSELEEGGVIMQAFYWDVPGGGIWWDTIRQKIPEWYDAGISAIWIPPASKGMGGGYSMGYDPYDFFDLGEYYQKGTVETRFGSKEELVNMINTAHSYGIKVIADIVINHRAGGDLEWNPFVNNYTWTDFSKVASGKYTANYLDFHPNEVKCCDEGTFGDFPDIAHEKSWDQYWLWASNESYAAYLRSIGIDAWRFDYVKGYGAWVVNDWLSWWGGWAVGEYWDTNVDALLNWAYDSGAKVFDFPLYYKMDEAFDNTNIPALVYALQNGGTVVSRDPFKAVTFVANHDTDIIWNKYPAYAFILTYEGQPVIFYRDYEEWLNKDKLNNLIWIHEHLAGGSTKILYYDNDELIFMREGYGSKPGLITYINLGNDWAERWVNVGSKFAGYTIHEYTGNLGGWVDRWVQYDGWVKLTAPPHDPANGYYGYSVWSYAGVG

SEQ ID NO: 127 - DNA, 1848 bp, Environmental
gtgtgcatgaattatttgaaaaaagtgtggttgtattacgctatcgtcgctaccttaatcatttactttcttacgcccttttcaactgcacaagccaacactgcaccagtcaacggaacgatgatgcaatatttcgaatgggatttaccgaatgatggcacactttggacgaaagtaaaaaacgaagcaagcagtctttcttctttaggtattactgcgttatggttaccacctgcatacaaaggaacgagccaaggggatgtcgggtatggcgtgtacgatttgtatgacttaggagaatttaatcaaaaagggacgattcgaacgaaatacggaacaaaaacgcaatatttacaagccattcaagcggcaaaaagcgctggcatgcaagtatacgctgatgtcgtatttaatcacaaggcgggggcagatagtacagaatgggttgacgcagtcgaagtgaatccttctaatcgaaaccaagaaacatctggcacatatcaaattcaagcatggacaaaatttgatttccctggccgtgggaacacatactcaagctttaaatggcgatggtatcattttgacggtacggattgggatgaaagccgaaaactaaatcgtatttacaaatttcgtggcacaggaaaagcatgggattgggaagtagacacagagaacggaaactatgactacttaatgtttgctgatttagatatggatcaccctgaagtcgtgacagagctaaaaaactggggaacatggtacgtcaatacgacaaatgtcgatgggtttcgcttagatgcagtaaagcatattaaatatagcttcttcccagattggttaacacatgtgcgttcacaaacacgaaaaaatctttttgcagtaggagaattttggagctacgatgtcaataaactgcataactacattacaaaaacaagtggaaccatgtcgttatttgatgcgccacttcataacaacttttacactgcttcaaaatctagcgggtattttgacatgcgctatttgttaaataatacgttgatgaaagaccagccttctcttgcggtcacactcgttgataatcatgacacgcaaccgggacaatctttacaatcatgggtagagccttggtttaagccgcttgcttatgcctttattttgacaagacaagaaggatatccttgcgtattttacggcgactattacggcatccctaaatacaacattccgggattgaaaagtaaaatcgatccgcttctcattgcccgtagagactacgcatacggaacacaacgtgattatattgaccatcaagacattattggatggacacgggaaggaattgactcaaaaccgaactctggacttgcggctttaattactgacggccctggtggaagtaaatggatgtatgtaggtaaaaagcatgctggaaaagtgttttacgatctcactggaaatcgaagcgatacggtaacgattaatgcagacggctggggagagtttaaagtaaacggtggctccgtttccatttgggttgccaaaacatcacaagtcacgtttaccgtcaacaatgcgacaacgataagcggacaaaatgtgtatgtcgttggtaacattccagagctcggaaattggaacacagcaaacgcaatcaaaatgaccccatcttcttatccaacgtggaaagcaaccattgctcttccacaaggaaaagccattgaatttaaatttattaaaaaagaccaatcgggaaatgttgtttgggaaagcattccaaaccgaacatacaccgttccatttttatcaacaggctcatatacagctagttggaatgtaccttaa

SEQ ID NO: 128 - protein, 615 aa, Environmental
VCMNYLKKVWLYYAIVATLIIYFLTPFSTAQANTAPVNGTMMQYFEWDLPNDGTLWTKVKNEASSLSSLGITALWLPPAYKGTSQGDVGYGVYDLYDLGEFNQKGTIRTKYGTKTQYLQAIQAAKSAGMQVYADVVFNHKAGADSTEWVDAVEVNPSNRNQETSGTYQIQAWTKFDFPGRGNTYSSFKWRWYHFDGTDWDESRKLNRIYKFRGTGKAWDWEVDTENGNYDYLMFADLDMDHPEVVTELKNWGTWYVNTTNVDGFRLDAVKHIKYSFFPDWLTHVRSQTRKNLFAVGEFWSYDVNKLHNYITKTSGTMSLFDAPLHNNFYTASKSSGYFDMRYLLNNTLMKDQPSLAVTLVDNHDTQPGQSLQSWVEPWFKPLAYAFILTRQEGYPCVFYGDYYGIPKYNIPGLKSKIDPLLIARRDYAYGTQRDYIDHQDIIGWTREGIDSKPNSGLAALITDGPGGSKWMYVGKKHAGKVFYDLTGNRSDTVTINADGWGEFKVNGGSVSIWVAKTSQVTFTVNNATTISGQNVYVVGNIPELGNWNTANAIKMTPSSYPTWKATIALPQGKAIEFKFIKKDQSGNVVWESIPNRTYTVPFLSTGSYTASWNVP

SEQ ID NO: 129 - DNA, 1854 bp, Environmental
atgcgttgccgccgtggcagggacgggtgttggtgcgggcggcgtaatgcgctgccgcgacacccgcgtgaacaaaataatatgaattatttgaataggatgggggtgtcaagaatgacaaaatctcgagagttgcggtgttcatggaaagtatttgttgttgggtgcctgttgtggatggcttggggatcttccgcgtccgccggcgtattgatgcaaggcttctactgggacgccagtaccgggaccagtgattcgtggtggacgcatttggccaagcaagccaacggtctaaaacgggcggggttcaccgccgtatggattcctccggtgcttaaaggggcttcagggggctattccaacgggtacgatccctttgacgactatgatatcggaagcaaggaccagaaaggtaccgtggcgacgcgatgggggacgcgagaagaactgcaacgtgccgtggccgtgatgcgcgcgaacggtctggatgtgtatgtggatctggtgctgaaccaccgcaacggggacgacgggaattggaattttcattacaaagatgcgtacggcaaagtgggttacgggcggtttcaaaaggggttttacgattttcaccccaactacaacattcaggatgccaatgttcccaacgaggattccagcttcgggcgcgatttagcccatgacaatccgtatgtggccgatggactgaaggctgcaggcgattggctgaccaaagccctcgatgttcagggatatcgtctggattacgtgaaaggcatcagctacaccttcctgaaaagttatctgtcctatggggccatgaacggaaaatttgccgtcggtgagtactgggatgccaaccgggatacgttgaactggtgggcgaacacggcgatggaagggcgggcccatgtgtttgattttgcgttgcgcgaggagctgaaaaacatgtgcaatgcggacgggtactacgacatgcgtcgattggaccacgcgggtctggtcggaatcgacccgtggaaggcggtgacgtttgtcgaaaaccatgatacggatcggcacgaccccatctacaataacaagcatttggcgtatgcctacatcttgacgtcggaagggtatccgacggtgttctggaaggattactaccaatacggaatgaagccgatcatcgacaacctcatttggatccacgaacacattgcgtacggaacgacccaagagcgttggaaagacgaagatgtctttgtgtatgagcggaccggaggcaagcggctattggtggggcttaacgacaatcgcgccaccagcaaaacggtcaccgtacagaccggctttggtgccaacgtggccttgcacgactacaccggcaacggccccgatctccgtaccgacgcctacggtcgggtaaccttgaccattcctgcaaacgggtacgtggcctattccgttccgggcatctccggatcctttgtgccggtcgagaaaaccgtgacgcaggagtttgccggggcgtccgacttggatattcgtccggccgataacacgcaatttgtgcaggtcgggcggatatacgccaaggcaaacaagccggttacagcggaattgtattgggatgccaaagactggacgacctccacgtcgattctcctagaagtgcgttcggcttcgggaacgctcatcacgacaaagaccgtgacccaattgtcgtcccagggtacccgcgtttccttcacgccttcggctaccggatggtacgtcttttccattcgaagctataacacgccttcgacgaacccaaagccggcctactggttaaaggtaacgtatacggcgccgcaattgcttcagtaa

SEQ ID NO: 130 - protein, 617 aa, Environmental
MRCRRGRDGCWCGRRNALPRHPREQNNMNYLNRMGVSRMTKSRELRCSWKVFVVGCLLWMAWGSSASAGVLMQGFYWDASTGTSDSWWTHLAKQANGLKRAGFTAVWIPPVLKGASGGYSNGYDPFDDYDIGSKDQKGTVATRWGTREELQRAVAVMRANGLDVYVDLVLNHRNGDDGNWNFHYKDAYGKVGYGRFQKGFYDFHPNYNIQDANVPNEDSSFGRDLAHDNPYVADGLKAAGDWLTKALDVQGYRLDYVKGISYTFLKSYLSYGAMNGKFAVGEYWDANRDTLNWWANTAMEGRAHVFDFALREELKNMCNADGYYDMRRLDHAGLVGIDPWKAVTFVENHDTDRHDPIYNNKHLAYAYILTSEGYPTVFWKDYYQYGMKPIIDNLIWIHEHIAYGTTQERWKDEDVFVYERTGGKRLLVGLNDNRATSKTVTVQTGFGANVALHDYTGNGPDLRTDAYGRVTLTIPANGYVAYSVPGISGSFVPVEKTVTQEFAGASDLDIRPADNTQFVQVGRIYAKANKPVTAELYWDAKDWTTSTSILLEVRSASGTLITTKTVTQLSSQGTRVSFTPSATGWYVFSIRSYNTPSTNPKPAYWLKVTYTAPQLLQ

SEQ ID NO: 131 - DNA, 1881 bp, Environmental
atgccgcagctttacccattgccgccgcgctggcggcgcgcggcccggcagggcctggccgccttgacgctggccaccacggccctgggcatctcgacggcccaggcccagagtgcaccgcgcacggccttcgtgcatctgttcgaatggaagtggaccgacatcgcgcgcgagtgcgagaccttcctcgggcccaagggcttcgcggcggtgcaggtgtcgcccccgaacgagcacaactgggtgaccagcggtgatggtgcaccttatccgtggtggatgcgctaccagccggtgagctacagcctggaccgcagccgcagcggcacgcgcgccgagttccaggacatggtcaaccgatgcaatgccgtgggcgtgggcatctacgtggacgccgtgatcaatcacatgtccggcggcacgggcggcacctcgagcgctgggcgcagctggagctatcacaactaccctgggctctatggccccaacgacttccaccagccggtgtgcagcatcaccaactacggggatgcgaacaatgtgcagcgttgcgagctctcgggcttgcaggacctggacactgggagcgcttatgtgcgcggcaagatcgccgactatctggtggatctggtcaacatgggggtcaagggcttccgggtggatgcggccaagcacatcagcccgaccgacctgggcgccatcatcgatgcggtcaacagccgcaccggcgcgaaccgccctttctggtttctggaggtgattggcgcggccggcgaggcagtgcagccgaaccagtacttctcgctcggcggcggccaggtcaccgtgaccgagttcaactatgggaagcaaatcttcggcaagttcgccggtggcggccgtctggccgagctgcgcagcttcggtgaaacctggggcctgatgcccagcagcaaagcgattgctttcatcgacaaccacgacaagcagcgcggtcatggcggcggtggcaactatctgacctaccaccatggctcgacctacgatctggccaacatcttcatgctggcttggccttatggctacccggcgctgatgtccagctatgccttcaaccgcagcacggcctacgacacgagctttggcccgccacacgacagtggtggcgccacccgtggcccctgggatggtggcggcagccagccggcctgcttcaaccagagcatcggtggctgggtgtgtgagcaccgctggcggggcatcgccaatatggtggccttccgcaacgccacgctgcccaactggaccgtgaccgactggtgggacaacggcaacaaccagatcgctttcgggcggggtgacaagggcttcgtggtgatcaaccgcgaagacgccgcgctgacgcgcaacttcaagaccagcctgccagccggccagtactgcgatgtcatctccggggacttcaacaatggtcagtgcacgggccatgtggtgacggtcgatgccggcggctacgtgacgctgacggccgggcccaatggtgcggcggccatccacgtgggcgcccgtctggacggcgcctctcagccgccgacgaccgcctcggtgacgttcaacgcgtcggccgataccttttggggacagaacctgttcgtcgtgggcaaccacagcgcactgggcaactggtcgccggcggccgccaggccgatgacttggatttccggttcgggcacgcgcgggaactggcgcgcggtgctcaatttgccggccaataccacctaccaatacaagttcatcaagaaggacggggctggaaacgtggtttgggagggcggtggcaatcgcgtcgtgaccacgccgtctgggggcggatcggtgagcacgggcggcaattggcagtag

SEQ ID NO: 132 - protein, 626 aa, Environmental
MPQLYPLPPRWRRAARQGLAALTLATTALGISTAQAQSAPRTAFVHLFEWKWTDIARECETFLGPKGFAAVQVSPPNEHNWVTSGDGAPYPWWMRYQPVSYSLDRSRSGTRAEFQDMVNRCNAVGVGIYVDAVINHMSGGTGGTSSAGRSWSYHNYPGLYGPNDFHQPVCSITNYGDANNVQRCELSGLQDLDTGSAYVRGKIADYLVDLVNMGVKGFRVDAAKHISPTDLGAIIDAVNSRTGANRPFWFLEVIGAAGEAVQPNQYFSLGGGQVTVTEFNYGKQIFGKFAGGGRLAELRSFGETWGLMPSSKAIAFIDNHDKQRGHGGGGNYLTYHHGSTYDLANIFMLAWPYGYPALMSSYAFNRSTAYDTSFGPPHDSGGATRGPWDGGGSQPACFNQSIGGWVCEHRWRGIANMVAFRNATLPNWTVTDWWDNGNNQIAFGRGDKGFVVINREDAALTRNFKTSLPAGQYCDVISGDFNNGQCTGHVVTVDAGGYVTLTAGPNGAAAIHVGARLDGASQPPTTASVTFNASADTFWGQNLFVVGNHSALGNWSPAAARPMTWISGSGTRGNWRAVLNLPANTTYQYKFIKKDGAGNVVWEGGGNRVVTTPSGGGSVSTGGNWQ

SEQ ID NO: 133 - DNA, 1638 bp, Environmental
atgaataatgtgaaaaaagtatggttgtattattctataattgctaccttagttatttcctttttcacacctttttcaacagcacaagctaatactgcacctgtcaacggaacaatgatgcaatatttcgaatgggatttaccgaatgatgggacgctttggacgaaagtaaaaaatgaagctaccaatctttcttcgctaggtattacagcgttatggctccctccagcatataaaggaacgagccaaagcgatgtcggatatggcgtgtacgatttatatgaccttggggaatttaatcaaaaagggacgatccgaacgaaatacggaacaaaagcacaatatattcaagccatccaagctgccaaagccgcagggatgcaagtatatgcagatgttgtatttaatcataaggcgggggctgacggcacagaatttgtcgatgcagttgaggtaaacccttctaatcgaaatcaagaaacatctggcacatatcaaattcaagcatggacaaaatttgattttcctggtcgtggaaacacatactccagcttcaaatggcgctggtatcattttgacggtaccgattgggatgaaagtcgtaaattaaatcgtatttacaaattccgcggtacaggaaaagcgtgggactgggaagtcgatacagaaaacggaaactatgattatttaatgttcgctgatttagatatggatcaccctgaagttgtgacagagttaaaaaactggggaaaatggtatgtaaatacgacaaatgtagacggatttcgtttggatgccgtaaaacatattaaatacagctttttccctgactggctaacatatgtacgtaatcaaacaggaaaaaatttatttgctgttggggaattttggagctatgacgtcaataagctgcataactacattacaaaaacaaatggatcgatgtcgttatttgatgcacctttgcataacaacttttatatcgcttccaaatcgagtggatattttgacatgcgttatttattgaataatacattaatgaaagatcaaccttcactcgctgtaacacttgtcgataaccatgatacacaaccaggtcaatctttacaatcatgggtagaagcttggtttaaaccgcttgcttacgcctttattttaacaagacaagaggggtatccttgcgtattttacggtgactattacggaatcccgaaatacaatattccgggattaaaaagtaaaattgatccgcttttaattgctcgtcgtgattatgcttatggaacacaacgtgattacattgatcatcaagacattatcggatggacacgagaaggcattgatgcaaaaccgaactctggacttgcggctttaattaccgacggccctggcggaagtaaatggatgtatgtcggtaaaaaacatgctgggaaagtgttttatgatttaactggaaatcgaagtgacacagtaacgattaatgcggacggttggggagaatttaaagtaaacggcggctccgtttcgatttgggtggctaaaacatcaaacgtcacatttacagtcaataacgccacaacaacaagtggacaaaacgtatatgttgttggcaacattccagagctaggcaattctttg

SEQ ID NO: 134 - protein, 546 aa, Environmental
MNNVKKVWLYYSIIATLVISFFTPFSTAQANTAPVNGTMMQYFEWDLPNDGTLWTKVKNEATNLSSLGITALWLPPAYKGTSQSDVGYGVYDLYDLGEFNQKGTIRTKYGTKAQYIQAIQAAKAAGMQVYADVVFNHKAGADGTEFVDAVEVNPSNRNQETSGTYQIQAWTKFDFPGRGNTYSSFKWRWYHFDGTDWDESRKLNRIYKFRGTGKAWDWEVDTENGNYDYLMFADLDMDHPEVVTELKNWGKWYVNTTNVDGFRLDAVKHIKYSFFPDWLTYVRNQTGKNLFAVGEFWSYDVNKLHNYITKTNGSMSLFDAPLHNNFYIASKSSGYFDMRYLLNNTLMKDQPSLAVTLVDNHDTQPGQSLQSWVEAWFKPLAYAFILTRQEGYPCVFYGDYYGIPKYNIPGLKSKIDPLLIARRDYAYGTQRDYIDHQDIIGWTREGIDAKPNSGLAALITDGPGGSKWMYVGKKHAGKVFYDLTGNRSDTVTINADGWGEFKVNGGSVSIWVAKTSNVTFTVNNATTTSGQNVYVVGNIPELGNSL

SEQ ID NO: 135 - DNA, 1935 bp, Environmental
gtgacaggcaccccgtctttatacattcctccacataaaataaccatacagctttcaaatttgttgaaatgtataaaaataaaaaatagtattgtaagcgttaacatccgtcattataataacttcaaacgcgtttatgttttaatgcaaacgtttgcatcctcattttatttaaagaaaggatgtgtgtgcatgaattatttgaaaaaagtgtggttgtattacgctatcgtcgctaccttaatcatttcctttcttacgcccttttcaactgcacaagccaacactgcaccagtcaacggaacgatgatgcaatatttcgaatgggatttaccgaatgatggcacactttggacgaaagtaaaaaacgaagcaagcagcctttcttctttaggtattactgcgttatggttaccacctgcatacaaaggaacgagccaaggggatgtcgggtatggcgtgtacgatttgtatgacttaggagaatttaatcaaaaagggacgattcgaacgaaatacggaacaaaaacgcaatatttacaagccattcaagcggcaaaaagcgctggcatgcaagtatacgctgatgtcgtatttaatcacaaggcgggggcagatagtacagaatgggttgacgcagtcgaagtgaatccttctaatcgaaaccaagaaacatctggcacatatcaaattcaagcatggacaaaatttgatttccctgaccgtgggaacacatactcaagctttaaatggcgctggtatcattttgacggtacggattgggatgaaagtcgaaaactaaatcgcatttacaaatttcgtggcacaggaaaagcatgggattgggaagtagacacagagaacggaaactatgactacttaatgtttgctgatttagatatggatcaccctgaagtcgtgacagagctaaaaaactggggaacatggtacgtcaatacgacaaatgtcgatgggtttcgcttagatgcagtaaagcatattaaatatagctttttcccagattggttaacatatgtgcgctcacaaacacaaaaaaatctgtttgcagtaggagaattttggagctacgatgtcaataaactgcataactacattacaaaaacaagtggaaccatgtcgttatttgatgcgccacttcataacaacttttacactgcttcaaaatctagcgggtattttgacatgcgctatttgttaaataatacgttgatgaaagaccagccttctcttgcggtcacactcgttgataatcatgacacgcaaccgggacaatctttacaatcatgggtagagccttggtttaagccgcttgcttatgcctttattttgacaagacaagaaggatatccttgcgtattttacggcgactattacggcatccctaaatacaatattccgggattgaaaagtaaaatcgatccgcttctcattgcccgtagagactacgcatacggaacacaacgtgattatattgaccatcaagacattattggatggacacgggaaggaattgactcaaaaccgaactctggacttgcggctttaattactgacggtcctggtggaagtaaatggatgtatgtaggtaaaaagcatgctggaaaagtgttttacgatctcactggaaatcgaagcgatacggtaacgattaatgcagacggctggggagagtttaaagtaaacggtggctccgtttccatttgggttgccaaaacatcacaagtcacgtttaccgtcaacaatgcgacaacgacaagcggacaaaatgtgtatgtcgttggcaacattccagagctcggaaattggaacacagcaaacgcaatcaaaatgaccccatcttcttatccaacgtggaaaacaaccattgctcttccacaaggaaaagcaattggcggcgtacgccatggcccttga

SEQ ID NO: 136 - protein, 644 aa, Environmental
VTGTPSLYIPPHKITIQLSNLLKCIKIKNSIVSVNIRHYNNFKRVYVLMQTFASSFYLKKGCVCMNYLKKVWLYYAIVATLIISFLTPFSTAQANTAPVNGTMMQYFEWDLPNDGTLWTKVKNEASSLSSLGITALWLPPAYKGTSQGDVGYGVYDLYDLGEFNQKGTIRTKYGTKTQYLQAIQAAKSAGMQVYADVVFNHKAGADSTEWVDAVEVNPSNRNQETSGTYQIQAWTKFDFPDRGNTYSSFKWRWYHFDGTDWDESRKLNRIYKFRGTGKAWDWEVDTENGNYDYLMFADLDMDHPEVVTELKNWGTWYVNTTNVDGFRLDAVKHIKYSFFPDWLTYVRSQTQKNLFAVGEFWSYDVNKLHNYITKTSGTMSLFDAPLHNNFYTASKSSGYFDMRYLLNNTLMKDQPSLAVTLVDNHDTQPGQSLQSWVEPWFKPLAYAFILTRQEGYPCVFYGDYYGIPKYNIPGLKSKIDPLLIARRDYAYGTQRDYIDHQDIIGWTREGIDSKPNSGLAALITDGPGGSKWMYVGKKHAGKVFYDLTGNRSDTVTINADGWGEFKVNGGSVSIWVAKTSQVTFTVNNATTTSGQNVYVVGNIPELGNWNTANAIKMTPSSYPTWKTTIALPQGKAIGGVRHGP

SEQ ID NO: 137 - DNA, 1320 bp, Environmental
gtgggacgggcaggcttggcgcatcactcgaacacttccgccaaggggacatacgggtcacctctcgaactgcgtccggatcgccccgccgtggccggggcggtcgagcttgaagatgtccagcggggagccgccgccgaggatcaccccggcggcgtactcgcccagggcggggctcagcttgaagccgtggccggagccgcctcccaggagccagacgttggaggcccgcggatggcggtcgaggaggaggtggccgtcggggctgttctcgtactggcagacgcgggtctcgaccagcggcgcgtccttcagggccgggaaccggcgggccacctcggcccgggccgcttccagcagggccggggtgatcgtccgctcgcccgccgtgggatcgatgggctcgccccgggtgtcgtccgccaccttgaagccgcggtgctcgttgccggggatgccgtagtagatccgctcgccgagatcgacccagaccggacagccgccctcctggaagcgcgggtcgcccggcggcgtgccgaagaagaacacctcctggcgggtgttgcggaggaaccgctcaccgatcacgtccgggaacagcccggccagccagggaccgcaggcgaagacgtagaggtcggccgcgagagtggagccgtccgaaaggtgaagccgctccaagggccccgggaccatggcggcctgccggtactccccgccctcgccctggaacagctccaccacggtccggcaggcgcgccgggcgaacagggcgccggcttcctcctcgtaccagatcgtgcggacgccgtcgaaatcgacctgggggaagcggctccgggcctccccctgagacagctcggcgaccggcagccccgcgtcctccagaaaaggaagggagtcgcggacgtagctgtcgtcctcgccgcacatccagaggaccccggtccttttgtacagccggtaaccggactggacttcggcgtcccgccagagctcgaaggagcgggcgacccactccacgtacagacggtcgggtccgtaggcgccgcggatgatccgcgtctcgccaccggagctggagcgggagtgccccggaccccaggcgtccaggagggtcacccgggctccgcggcggaggagatgcagggcggtccagccgccgaaggcgccggcgccgacgacggcgatatggggatgggagggcatggcgggcgtaaggttatcgcagcccgatccttcgctggcatcccatctccgaccggagtatcctggaaaattcgaagaaggagatcgacatgcaatcgaacggaaacgtga

SEQ ID NO: 138 - protein, 439 aa, Environmental
VGRAGLAHHSNTSAKGTYGSPLELRPDRPAVAGAVELEDVQRGAAAEDHPGGVLAQGGAQLEAVAGAASQEPDVGGPRMAVEEEVAVGAVLVLADAGLDQRRVLQGREPAGHLGPGRFQQGRGDRPLARRGIDGLAPGVVRHLEAAVLVAGDAVVDPLAEIDPDRTAALLEARVARRRAEEEHLLAGVAEEPLTDHVREQPGQPGTAGEDVEVGRESGAVRKVKPLQGPRDHGGLPVLPALALEQLHHGPAGAPGEQGAGFLLVPDRADAVEIDLGEAAPGLPLRQLGDRQPRVLQKRKGVADVAVVLAAHPEDPGPFVQPVTGLDFGVPPELEGAGDPLHVQTVGSVGAADDPRLATGAGAGVPRTPGVQEGHPGSAAEEMQGGPAAEGAGADDGDMGMGGHGGRKVIAARSFAGIPSPTGVSWKIRRRRSTCNRTET

SEQ ID NO: 139 - DNA, 1524 bp, Environmental
atgaaaacattcaaccttaaacccacacttttacctttaactttgctgctgagttcgccggtattggcggcacaaaatggaactatgatgcagtatttccattggtatgtgccaaatgacggcgcactctggacacaagttgaaaacaatgcgccagcactatccgacaacggttttacagcgctgtggttgccaccagcatataaaggcgcaggtggtagcaacgacgttggttacggtgtttacgatatgtatgacttaggggagtttgatcaaaaaggatcggtacgaactaagtacggcaccaaagaccaatatctaaatgccatcaaagcagcacacaaaaacaatatccaaatttatggtgacgtagtgttcaaccatcgtggcggtgcagatggcaagtcgtgggtcgataccaagcgtgtggattggaataaccgcaatattgaacttggcgataaatggattgaagcatgggttgaatttagcttcccaggacgtaacgataaatactcagacttccattggacgtggtatcactttgatggcgtcgattgggatgacgcaggtaaagagaaagcgatctttaaattcaaaggtgatggtaaagcatgggattgggaagtcagttctgaaaaaggcaactatgactacctcatgtacgcagacttagacatggatcacccagaagtgaagcaagagctgaaagattggggtgaatggtacttaaacatgacgggtgttgatggcttccgaatggatgcagtgaaacacatcaaatatcagtacctacaagagtggatcgattacttgcgtaagaaaacgggcaaagagctctttaccgttggtgagtactggaactacgacgtgaacaatctgcacaactttatgactaagacttctggcagcatgtcattgtttgatgcgcctttacatatgaacttctataacgcttcacgctctggtggcaactttgatatgcgccgaatcatggatggcaccttgatgaaagacaacccagtgaaagcagtaacactggttgagaaccatgatacgcaaccactacaggccttagagtctccggtggattggtggttcaaaccacttgcgtacgcgttcattttgcttcgtgaggaaggttatccgtcagtcttctacgcagattactacggtgcgcaatacagcgataaagggcacgatatcaacatggtgaaagtgccttacattgagcaattggtgaaagcgcgtaaagattatgcttatggtaaacaacattcttaccttgaccactgggatgtgattggttggacacgagaaggggatgcggaacatccgaactctatggcggttatcatgagtgatggtcctggcggaacaaagtggatgtacacaggttcaccgagcacacgttatgtcgataaactaggtattcgtaccgaagaagtatggactaacgctagtggatgggccgaattcccagtgaacggcggatcggtttctgtttgggttggcgttaaataa

SEQ ID NO: 140 - protein, 507 aa, Environmental
MKTFNLKPTLLPLTLLLSSPVLAAQNGTMMQYFHWYVPNDGALWTQVENNAPALSDNGFTALWLPPAYKGAGGSNDVGYGVYDMYDLGEFDQKGSVRTKYGTKDQYLNAIKAAHKNNIQIYGDVVFNHRGGADGKSWVDTKRVDWNNRNIELGDKWIEAWVEFSFPGRNDKYSDFHWTWYHFDGVDWDDAGKEKAIFKFKGDGKAWDWEVSSEKGNYDYLMYADLDMDHPEVKQELKDWGEWYLNMTGVDGFRMDAVKHIKYQYLQEWIDYLRKKTGKELFTVGEYWNYDVNNLHNFMTKTSGSMSLFDAPLHMNFYNASRSGGNFDMRRIMDGTLMKDNPVKAVTLVENHDTQPLQALESPVDWWFKPLAYAFILLREEGYPSVFYADYYGAQYSDKGHDINMVKVPYIEQLVKARKDYAYGKQHSYLDHWDVIGWTREGDAEHPNSMAVIMSDGPGGTKWMYTGSPSTRYVDKLGIRTEEVWTNASGWAEFPVNGGSVSVWVGVK

SEQ ID NO: 141 - DNA, 1401 bp, Environmental
atgaaaccaataaataccctactcatatccgcccttgctgtttgttctttcagttccgcgacttacgccgatactattttgcacgcgttcaattggaagtattcagatgtgacggccaacgcgaatcaaattgctcaagctggttataagaaagtgcttgttgcgcctgcaatgaaatcgagtggcagccaatggtgggctcgctatcaacctcaagatctacgcactatcgattctcctttgggcaataaacaagatttagccgcaatgattgccgcactcaaaggtgtgggcgtcgatgtgtatgccgatgtggtactcaaccatatggcgaatgaaagctggaagcgaagtgacttgaattaccctggcacagaagtgctaaacgattatgctagccgttcaagctactatgctgaccagactctgtttggcaacctagcacaaggttatgtgtcagcgaacgactttcatccagcgggctgtatttcagattggaacgaccctggtcatgttcagtattggcgtttgtgtggcgcagatggtgatgtaggtttacctgaccttgatccaaacaactgggtggtttcacaacagcgtttgtatctgaaagcgctaaaagatatgggcatcaaagggttccgaattgatgcagtgaagcacatgagccaataccaaatcgatcaggtattcacgtctgaaattactgcgaacatgcatgtgtttggtgaagtgattactagcggtggagcagggaatagcggctatgaatcgttcttagcgccttacctgaataatactaatcactctgcctacgatttcccgctgtttgcatcgattcgctcggcattttctatggggggcggtttaaatcaactgcatgatcctaaagcgtacggtcaggcacttgatgataatcgctcgatcacctttgcgatcacacatgatattccaaccaatgacggcttccgctaccaaattatggacccacaagacgagcagcttgcttacgcgtatatccttggtaaagacggtggcacgccgctgatctacagtgatgatcttcctgattctgaagacaaggataacggtcgttggggcaatgtttggaacagttcgacaatgaaaaacatgttgagcttccataacgcgatgcaaggcaaaacaatgacgatgatttctagcgaccattgcactttgttgtttaagcgtggcaaagaaggtgttgtgggtattaacaagtgtggtgaaacgcgtggcgtgacggttgatacctaccaacatgagtttaattggcatgttcaatacaaagacgtgttaagcagcgcaacagaaaccgtgacttctcgttaccatacgttcaatctaccaccacgcagtgcgcgtatgtttaagctgtag

SEQ ID NO: 142 - protein, 466 aa, Environmental
MKPINTLLISALAVCSFSSATYADTILHAFNWKYSDVTANANQIAQAGYKKVLVAPAMKSSGSQWWARYQPQDLRTIDSPLGNKQDLAAMIAALKGVGVDVYADVVLNHMANESWKRSDLNYPGTEVLNDYASRSSYYADQTLFGNLAQGYVSANDFHPAGCISDWNDPGHVQYWRLCGADGDVGLPDLDPNNWVVSQQRLYLKALKDMGIKGFRIDAVKHMSQYQIDQVFTSEITANMHVFGEVITSGGAGNSGYESFLAPYLNNTNHSAYDFPLFASIRSAFSMGGGLNQLHDPKAYGQALDDNRSITFAITHDIPTNDGFRYQIMDPQDEQLAYAYILGKDGGTPLIYSDDLPDSEDKDNGRWGNVWNSSTMKNMLSFHNAMQGKTMTMISSDHCTLLFKRGKEGVVGINKCGETRGVTVDTYQHEFNWHVQYKDVLSSATETVTSRYHTFNLPPRSARMFKL

SEQ ID NO: 143 - DNA, 1422 bp, Environmental
atgccaaagagcacttttaccaaatccataacaaaatcacttcttgctacttccgttgttgtaagcttattgcctgcctacgcacaggccgacactatcttgcatgcctttaactggaaatacagcgacattacccgccaagcagagcaaattgcgcaagctggttataaaaaagtactgatttcaccgccgctgaagtccacaggcccacaatggtgggcacgttaccaaccacaggacattcgagtgattgactcccctgtcggcaacaagcaagatttacaagccctcattgcagccttaaaggcacaaggcgttgaagtatacgcagacatcgtactcaaccacatggccaacgaaagctggaaacgagacgatctgaactacccgggaagtgatttacttacccaatacagccaaaatatggcttacatgaaccagcaaaaattgtttggagatttagagcaaaatcagttctctgccaatgattttcacccggctggctgcattactgattggagtaacccggggcatgttcaatactggcgcttatgtggtggtaatggtgacactgggttacctgatcttgatcctaactcgtgggtgatcgatcaacaaaaacgttatttacgtgctttgaaagacatgggaataaagggcttccgagttgatgcggtaaaacacatgagcgattaccaaatcaaccaagtgtttacgccagacatcatcgcaggcttacatgtatttggtgaagtgatcaccagtggtggcaagggcagcaatgactaccactcttttctggaaccgtatttaaataacaccaatcacgccgcgtatgacttcccgctatttgcctctatccgaaatgcatttagttatcatggcagcttgtctcaattacatgatccacaagcttacgggcaagcacttcctaacgacagagccattactttcaccatcactcacgacattccaaccaatgatggtttccgttaccaaatcatggatccaaccagtgaaaaactcgcgtacgcgtacattctaggcaaagatgggggtagcccacttatctatagcgatgctttagacccaagtgaagataaagataagggccgctggcgtgatgtatggaaccaagaatacatggttaacatgatcagcttccacaacaaggtgcaaggtaaaagcatggaggtcatgtacagcgatcaatgcttgctggtctttaaacgtgaaaaacaaggcttagtcggtattaataagtgcgctgaaagccgtacctacaccatagatacccatcgttttgaatttaactggtaccaaccgtacaacgacacattaagccagcacagcgagacctttagcagccgttatcatgctctgaccattccggcgcaaacagcacgaatgttggcgctataa

SEQ ID NO: 144 - protein, 473 aa, Environmental
MPKSTFTKSITKSLLATSVVVSLLPAYAQADTILHAFNWKYSDITRQAEQIAQAGYKKVLISPPLKSTGPQWWARYQPQDIRVIDSPVGNKQDLQALIAALKAQGVEVYADIVLNHMANESWKRDDLNYPGSDLLTQYSQNMAYMNQQKLFGDLEQNQFSANDFHPAGCITDWSNPGHVQYWRLCGGNGDTGLPDLDPNSWVIDQQKRYLRALKDMGIKGFRVDAVKHMSDYQINQVFTPDIIAGLHVFGEVITSGGKGSNDYHSFLEPYLNNTNHAAYDFPLFASIRNAFSYHGSLSQLHDPQAYGQALPNDRAITFTITHDIPTNDGFRYQIMDPTSEKLAYAYILGKDGGSPLIYSDALDPSEDKDKGRWRDVWNQEYMVNMISFHNKVQGKSMEVMYSDQCLLVFKREKQGLVGINKCAESRTYTIDTHRFEFNWYQPYNDTLSQHSETFSSRYHALTIPAQTARMLAL

SEQ ID NO: 145 - DNA, 1542 bp, Environmental
atgttgaaaaggattacggtagtctgtttattatttattttgctttttcctaatatatatgggaggaataaggcggaagcagcaacgataaataatggaacattaatgcagtattttgagtggtacgctccgaatgatgggaatcattggaatcgtttgcgttatgatgctgaaagtttagctcataagggaatcacatctgtatggataccacctgcatataaagggacttcgcaaaatgatgtagggtatggggcctatgatttatacgatttaggggagttcaatcaaaaaggaacggtgcggacgaaatatgggacaaaggcacagttgaaatctgcaattgacgctttacataagcaaaacatcgacgtatacggtgatgtagttatgaatcataaaggtggggctgattatactgaaaccgtaacagctgttgaggtagaccgtaacaatcgaaatattgaagtatcaggtgattatgaaattagtgcgtggacgggttttaactttccagggcgcagagatgcttattctaatttcaaatggaaatggtatcattttgacggaacggattgggatgaaggaaggaaattaaaccgaatttataaatttaggggtataggtaaagcgtgggactgggaagtgtctagcgaaaatggaaattatgattatttgatgtatgcagatcttgattttgatcatccagatgttgcgaatgaaatgaaaagttggggaacgtggtatgcgaatgaattaaatttagatggatttcgtttagatgctgttaaacatattgatcatgaatatttacgcgattgggtaaatcatgtcagacagcaaacggggaaagaaatgtttacggtggctgaatattggcaaaatgatatccagactttaaacaattatttggcgaaagtcaattataatcaatctgtatttgatgcaccgcttcattacaattttcattatgcttcaacaggaaatgggaattatgatatgagaaatattttaaatggaacagtaatgaaaaatcatcctgcactcgcagttactctcgttgagaatcatgattctcaacctgggcaatcattggaatctgtagtaagtccgtggtttaagccgctggcatatgcatttattttaactcgtgcagagggctatccttcagttttttatggtgattactatgggacaagcggaaatagtagttatgaaattccagcgttaaaagataaaattgatccaattttgacggcacgaaaaaactttgcatatggtacgcagcgtgattatttagaccatccagatgtgattggctggacaagagaaggagatagtgtacatgctaagtctggtttagcggcattaatctccgatggaccaggaggatcaaagtggatggatgttggaaagaataacgctggggaagtatggtacgatattacgggtaatcaaacaaatactgtaacaattaataaagatggatcggggcaattccatgtaagtggaggctctgtttctatatatgttcaacagtaa

SEQ ID NO: 146 - protein, 513 aa, Environmental
MLKRITVVCLLFILLFPNIYGRNKAEAATINNGTLMQYFEWYAPNDGNHWNRLRYDAESLAHKGITSVWIPPAYKGTSQNDVGYGAYDLYDLGEFNQKGTVRTKYGTKAQLKSAIDALHKQNIDVYGDVVMNHKGGADYTETVTAVEVDRNNRNIEVSGDYEISAWTGFNFPGRRDAYSNFKWKWYHFDGTDWDEGRKLNRIYKFRGIGKAWDWEVSSENGNYDYLMYADLDFDHPDVANEMKSWGTWYANELNLDGFRLDAVKHIDHEYLRDWVNHVRQQTGKEMFTVAEYWQNDIQTLNNYLAKVNYNQSVFDAPLHYNFHYASTGNGNYDMRNILNGTVMKNHPALAVTLVENHDSQPGQSLESVVSPWFKPLAYAFILTRAEGYPSVFYGDYYGTSGNSSYEIPALKDKIDPILTARKNFAYGTQRDYLDHPDVIGWTREGDSVHAKSGLAALISDGPGGSKWMDVGKNNAGEVWYDITGNQTNTVTINKDGSGQFHVSGGSVSIYVQQ

SEQ ID NO: 147 - DNA, 2343 bp, Environmental
atgagcttaaataactttaaggtaaaactgcttagttttgctgtgtcttctgctgtattgtcactggctccaaatttagccaatgctgcaaattttgaaagtgagatggtgataatccatccgtttcagtggacatatgacaatatagcaaaagagtgtacagagtaccttggtccagccggatttgacggtgtacagatttcccagccagcggaacataagcgggctgaaggagtatggtgggccgtatatcagccggttaattataagaattttacaaccatgaccggtaacgaggagcagcttaaggcaatgatcaagacctgtaatgatgcaggtgttaaggtgttcgctgacgctgttttcaaccaaaaggctacagacggtgtaggctggggcggttcaacttggagttataagaactaccctgacggattctccggatcagatttccatggagactgttccattgacaaaagctatactgatgcaaataatgtcagaacctgtgcactctcaggtatgccggacgttgccacagataactccgctactcaggaaaagattgcagattacctcgcttctttaatgaatatgggggtctatggtttccgtattgacgctgcaaagcacatgggatacaacgatatcaactccattctttcaaaaactgcacagaagactggaagaagacctcctgcatatctggaagtaatcggagccggtaacgaagctgccgacattcagccggacaagtatacctttattgagaatgcggttgtaactgacttcggttatgtctgggatgcaaatgagagtttcggaaagggtaattacggtaaggcactggaactcagtacctggctcggtgcaaattcagaaacattcgtaaacaatcatgatgatgaatggggcagatgctcagccggtagctgctcaatgaaaactcagaattatgctgattataatctggctcagtcctggcttgctgtatggcctgtaggtacagtaagacagatatattccggttattcattccctgtaaaagataatgatccttatcgcgtcagtgatgcaactcatgatcagggcgggcctcttggtgccgaccgctgtgaaggtggctggttgtgtcagcaccgtgtgtccttcgttctcaattccccaagatttgcgagagctaccagaggtactgctgtatcaaccaagggatttgacaatggtgctttgtggtttaacagaggaagcaaaggtttttatgcacagaatactaccaacagtcctataacccagacattctctgttgaagtacctgacggaaattactgtgatatcttaggaacatcagatcctaagagcaatccatgcggagcagacgttgtcgtaagcggcggtaaggctacctttactattcctgcaaagacagctgtggctatctgtacagactcagactggtgcggcaagggggttgatccttgtgaaagtgatccgaccggtgctgcctgtgtttgtaagggggaaaccaccgttaatggtgtgtgcgtcagctggtgtaatgcgcattcatcaaatgaggaatgcacctgtgtattgaatccgaatgatgccaactgtcaggctgatattgaacctaccaagggtaaactctgttacgccggtacttcaaacgggtggaaacaggatcctttaacatataaccgtaaaacaggtttctggactattaatctgactcttgacggtgcaggtgataccagcggagctcagcgcttcaaggttacagacggatgttcatggaccggaacagtttacggttcttcaggtactgccggaaagttggatgtaaatacatcatcaaccggcgatgaacctgtgtctcttgttggtgattatgttctttccattaacgataagaccatggaatatacattcaccaaggcagatgaagtaactaatcagccaccggttgcatcatttaccgcgacagttaacggtctgaccgtttcttttgccaataattcatccgaccctgagaatgatgaattaacctacagctggaatttcggtaatggtaaaacatcatccgagaaagctcctagcataacctatgaagaatccggtaagtatactgttactttaaaggttactgattcagctaataacactgatacatttactaaagatataactgtaacagcaccttctagtggcaagtacttaaaggttgcagtcagaggttcgcatgataattacggaactgatctgttaaccaagaacggttctgattggaccggcgtctttgaattctttggatccactagtgtcgacctgcaggcgcgcgagctc

SEQ ID NO: 148 - protein, 781 aa, Environmental
MSLNNFKVKLLSFAVSSAVLSLAPNLANAANFESEMVIIHPFQWTYDNIAKECTEYLGPAGFDGVQISQPAEHKRAEGVWWAVYQPVNYKNFTTMTGNEEQLKAMIKTCNDAGVKVFADAVFNQKATDGVGWGGSTWSYKNYPDGFSGSDFHGDCSIDKSYTDANNVRTCALSGMPDVATDNSATQEKIADYLASLMNMGVYGFRIDAAKHMGYNDINSILSKTAQKTGRRPPAYLEVIGAGNEAADIQPDKYTFIENAVVTDFGYVWDANESFGKGNYGKALELSTWLGANSETFVNNHDDEWGRCSAGSCSMKTQNYADYNLAQSWLAVWPVGTVRQIYSGYSFPVKDNDPYRVSDATHDQGGPLGADRCEGGWLCQHRVSFVLNSPRFARATRGTAVSTKGFDNGALWFNRGSKGFYAQNTTNSPITQTFSVEVPDGNYCDILGTSDPKSNPCGADVVVSGGKATFTIPAKTAVAICTDSDWCGKGVDPCESDPTGAACVCKGETTVNGVCVSWCNAHSSNEECTCVLNPNDANCQADIEPTKGKLCYAGTSNGWKQDPLTYNRKTGFWTINLTLDGAGDTSGAQRFKVTDGCSWTGTVYGSSGTAGKLDVNTSSTGDEPVSLVGDYVLSINDKTMEYTFTKADEVTNQPPVASFTATVNGLTVSFANNSSDPENDELTYSWNFGNGKTSSEKAPSITYEESGKYTVTLKVTDSANNTDTFTKDITVTAPSSGKYLKVAVRGSHDNYGTDLLTKNGSDWTGVFEFFGSTSVDLQAREL

SEQ ID NO: 149 - DNA, 2502 bp, Environmental
atgatcttaagtaattttaaggtaaaacttcttagttttgctgtgtcttctgctgtactgacactggctgcaaatgtcgccaatgccaagaattatgaaagtgaaatggttattattcatccatttcagtggacatatgacaatatagcaaaagaatgtactgagtatctgggacctgcgggatttgacggggtgcagatttcccaggcggctgagcataaagatgccggtggtgcatggtggggtacctaccagcctgtaaacttcaagagttttactaccatggttggtaatgaagaacagcttagagcaatgattaaaacctgtaacgaggcaggtgttaaggtctttgccgatgccgtgattaatcagaaagccggcgacggtgtaggtataggtggttcaactttcggaaattataattatcctgacggatttaccagtgatgattttcatcataataactgcagtataggtaataattattcagatgcatgggtagtaagattctgtgacctcagtggcatgccggatatagcaactgataacgacagtaccagaaataagattgctgattacttcgccagccttatgaatatgggggtatacggattccgtattgatgctgccaagcactttagctatgatgatatagacgctattgtagagaaaacagcaaccaaagcaggcaggagacctcctgtctatatggaggttatcggtaatccgggtcaagaggcggatgatatccagccgaacaagtatacatggattgataatgccgttgtaacagattttacttatgctaatagcatgcataatatttttaacggaagcggttatgccaaggctttgaacatggggctagggcatgttgatgctgaaaatgccgaagtctttataagtaatcatgataatgaatggggaagaaagtctgccggttcctgctcaataagaacccagaataatccggattaccatctggctcagtcctggctcgcagtttggcctttaggcaaggttagacagatttattctgcatatcagttcccggtctttgaagatagttgtgagcgggtcagtcagcaagcccatgatcagggcggtcctatcggggcagcccgctgtgaaggtggctggttgtgtcagcaccgtgtaccgtttgtgctcaattctcctagatttgcaagagcaaccagagggacagtcgttactactaaaggttttgatgacggagctttgtggtttaacagaggaagcaagggcttctatgcccagaatactaccggcagttctataactcatacattctcagttgaattacctgatggaaattactgtgatatccttggagcaaccgatccgaagaataatccttgcggagcggatgtcactgtaagcggaggtaaagcaacctttaccattccggcaaagaccgccgtagctatctgtactgatgaaaagtggtgtggcaagggggttgacccttgtgaaagcgatcctaccggttccgcctgtgtatgtaagggtgaaaccacagttaacggcgtatgtgtaagctggtgtaatgctcactcatctaatgaagaatgtgcctgtgtgctaaatcctaatgacgctgagtgtcaggccgacattgagccgaccaagggtaaactctgctatgtaggtacctccaacaagtggactcaggaacctttaacctataatcgcaagaccggtttctggactctcaacgttgaacttgacggtaagggggataccagcggggcgcagcgctttaaagttaccgacggctgttcatggcagggtactgtttacggttcatcaggagtagaaggcagacttgacgtaaatacttcagccaccggagatgaaccggtttcactgacaggtaaatatgttctttccataaatgataagaccatggaatacacattcattcctgcaggcagtggaaacaagcctccggttgcgtcatttactccgactgttaaagatctgactgtatcttttgtcaataattcatccgaccctgagaatgatgaattaacctacagctggaatttcggtaacggtaaaacctcatctgaaaagaatccgagtgttacatatgataaagccggtaaatatactgtttcactcaaagtaaccgatactgcaaacaacactgataccaaaacactggaaatcgatttaacatctcctgttaacggaaaatattccaaggttgcagtcagaggttcacatgataactacggaacaaatctgttaaccaggaatggttcagaatggaccggtatctttgaattcagtaagacaaccaaattcaagcttgaagctctgcctcctgcagctgaccagtgtatcttcctcggcggtaatcgaggtgaggcattgactgcctccggtggatttatatctcttcctgccggaaggtatactataaagtttaatgaggaaagcaaggttcttactgcaggcgatgttgactgcaccggg

SEQ ID NO: 150 - protein, 834 aa, Environmental
MILSNFKVKLLSFAVSSAVLTLAANVANAKNYESEMVIIHPFQWTYDNIAKECTEYLGPAGFDGVQISQAAEHKDAGGAWWGTYQPVNFKSFTTMVGNEEQLRAMIKTCNEAGVKVFADAVINQKAGDGVGIGGSTFGNYNYPDGFTSDDFHHNNCSIGNNYSDAWVVRFCDLSGMPDIATDNDSTRNKIADYFASLMNMGVYGFRIDAAKHFSYDDIDAIVEKTATKAGRRPPVYMEVIGNPGQEADDIQPNKYTWIDNAVVTDFTYANSMHNIFNGSGYAKALNMGLGHVDAENAEVFISNHDNEWGRKSAGSCSIRTQNNPDYHLAQSWLAVWPLGKVRQIYSAYQFPVFEDSCERVSQQAHDQGGPIGAARCEGGWLCQHRVPFVLNSPRFARATRGTVVTTKGFDDGALWFNRGSKGFYAQNTTGSSITHTFSVELPDGNYCDILGATDPKNNPCGADVTVSGGKATFTIPAKTAVAICTDEKWCGKGVDPCESDPTGSACVCKGETTVNGVCVSWCNAHSSNEECACVLNPNDAECQADIEPTKGKLCYVGTSNKWTQEPLTYNRKTGFWTLNVELDGKGDTSGAQRFKVTDGCSWQGTVYGSSGVEGRLDVNTSATGDEPVSLTGKYVLSINDKTMEYTFIPAGSGNKPPVASFTPTVKDLTVSFVNNSSDPENDELTYSWNFGNGKTSSEKNPSVTYDKAGKYTVSLKVTDTANNTDTKTLEIDLTSPVNGKYSKVAVRGSHDNYGTNLLTRNGSEWTGIFEFSKTTKFKLEALPPAADQCIFLGGNRGEALTASGGFISLPAGRYTIKFNEESKVLTAGDVDCTG

SEQ ID NO: 151 - DNA, 2112 bp, Environmental
atgaaaactattctttcaacaatcatggtgatggcggctgcggctgccaccaccgtagaggctcaaggctggccggaaaactacggcggcgtcatgttgcagggattctactgggattcctattcagccaccaagtggactaaactggaagcacaggctgacgagatctgcaactatttctcgctggtatgggtaccacagtcggcctataccggcagcagtacctccatgggctacgacccgctgtattacttcgaccagcattcatcgttcggcaccgaagagcagctacggtcgttcatcagtacctacaagcagaaaggaactggcatcatagccgatgtagttgtcaatcaccgaaagaatgtctcaaactgggtggatttcccggccgagacctacaacggtgtaacctatcagatggtaagcaccgacatcgtttcgaacgatgacggcggaaaaacagccacttgggcaaatcaaaacggctacagtctctcctccaatgccgacgaaggcgaaggctgggacggcatgcgcgacctggaccacaagtcgcagaacgtgcagaaatcggttcttgcctacaccaaatatctggttgacgacttaggctataccggattccgctacgatatggtaaagggatttgacggatcgcatgtagccgactacaacaccaatgccggcgtgcagttctctgtcggcgaatattgggacggcactgcatcgaaagtttacagttggatcaacagcaccaaaaagagcgatgtgccgcagtcggcagccttcgacttcgctttccgatacacctgccgcgatgccgtcaacaacaagaactgggcgaacctgaagaacacttccggtatcagcgatgccgattacaggcgctattcggttacgtttgttgaaaatcacgatacggaataccgttcagctacggcttcccaggatcccatcaagggtgatacggttgccctcaatgcctggatgctggctatgccgggcacaccttgtgttttcctgaaacattggaccgactgcaaggaagagatcaagaatctcatcgaggcacgtcgcctggtcggtattcacaaccagagcacctatgccgaatggatgagcggtgcagcctacatcggacgtaccgtaacaggtacgaacggcaccttacgtgttctgtgcggctcttatcagtataatgtagccgccaactacattcagattctctcaggcaaaaactataaatactacgtactcaacacgctcgaggctccctggatcgggaaaggttccggctcgtacaccgaaggtgaaaccgtaacggttccgctcatcgccatatcggccgatgccaatgccaagctggtatataccaccgacggcacagaccccaccgcaacctcaacagccgtaaccagcggaacggaactgaccatcacttcggacgccgtcctgaaggttggtctgctttccggcggcatcgtcaggaacatacagagccgtacattcaccttccaggctgcaaacacctccgagtattacacagccaccatgcacgtatgcaaccagtccggagctctcaatccgctgtttgcctatgtttgggcaggaccggacaacgagcagattaacggcaactggccgggcaccaagctcaccgctaccattaccgaaaacaaccttacctggtacacgcagtcgttccagattccgaagaacgtggactatgtcgtgaactttgttttcaccacaaccggcggcggtacgcagacagtggatgttaccggcatgaaggccgatgtctggtacattattaacagtaccaagagcggcaacaagtacacggtaaccgacgttacctcacagtattcttcgttagaggccatctttgatgaagaaaactccggctccttccctgtctatgacctgcagggacgccgcgtcagcgaaattagaaacaggacaattatatcttcagaacggaaagaagatactcatcagataaacagaggttccgaaccattctcctattatgaaaatcagacacttagtaatctcagcactgctgggtttggggggcttgtacaccatcagctgctcctcgtcggg

SEQ ID NO: 152 - protein, 704 aa, Environmental
MKTILSTIMVMAAAAATTVEAQGWPENYGGVMLQGFYWDSYSATKWTKLEAQADEICNYFSLVWVPQSAYTGSSTSMGYDPLYYFDQHSSFGTEEQLRSFISTYKQKGTGIIADVVVNHRKNVSNWVDFPAETYNGVTYQMVSTDIVSNDDGGKTATWANQNGYSLSSNADEGEGWDGMRDLDHKSQNVQKSVLAYTKYLVDDLGYTGFRYDMVKGFDGSHVADYNTNAGVQFSVGEYWDGTASKVYSWINSTKKSDVPQSAAFDFAFRYTCRDAVNNKNWANLKNTSGISDADYRRYSVTFVENHDTEYRSATASQDPIKGDTVALNAWMLAMPGTPCVFLKHWTDCKEEIKNLIEARRLVGIHNQSTYAEWMSGAAYIGRTVTGTNGTLRVLCGSYQYNVAANYIQILSGKNYKYYVLNTLEAPWIGKGSGSYTEGETVTVPLIAISADANAKLVYTTDGTDPTATSTAVTSGTELTITSDAVLKVGLLSGGIVRNIQSRTFTFQAANTSEYYTATMHVCNQSGALNPLFAYVWAGPDNEQINGNWPGTKLTATITENNLTWYTQSFQIPKNVDYVVNFVFTTTGGGTQTVDVTGMKADVWYIINSTKSGNKYTVTDVTSQYSSLEAIFDEENSGSFPVYDLQGRRVSEIRNRTIISSERKEDTHQINRGSEPFSYYENQTLSNLSTAGFGGLVHHQLLLVG

SEQ ID NO: 153 - DNA, 1620 bp, Environmental
atgccttcaattaatgcaagcgattgcaaaaaaaagggagataggagtatgaagaggaaaaaatggactgcgttagcactatctttaccactagttatgagcttatcaacaaacatacaagcagaaacattacataataataagggtcaaaaggcgcaaacaggaaataaagacggaattttttatgaactgtatgttaattctttttatgatactgatagcaatggacatggtgatttaaaaggcgtcacaaagaaacttgattatttaaatgatggaaatccaagaacaaataatgatcttcaaataaacggtatctggatgatgcctattaacacctctcctagttatcacaaatatgatgtaacagattactataatatcgatcctcagtatggaagtttacaagatttccgtgaactaacaacagaagcgcataaacgcaacgtaaaggtagtaatagatcttgttattaatcatacaagcagtgagcatccttggtttgtcgatgcattaaaaaataaaaacagtaagtatcgagattactatatttgggctgataaaaatacagacttaaatgaaaaaggcccatggggtcaacaagtatggcacaaagcgtcgaacggagagtatttctacgcaacgttctgggaagggatgccggacttaaactatgacaaccctaaagtaagagaagaaatgattaaaatcgggaaattttggctcaaacaaggagctgatggctttcgtctagatgcagccatgcacatctttaaagggcaaacacctgaaggagcaaagaaaaatattgaatggtggaatgaattccgcgacgcgatgagagaaacgaatccaaatacgtatctagttggtgaaatatgggatcaaccagaagtagttgctccgtattatcaatcgttagattctacatttaacttcgacttagcatataaaatcgttaattccgttaaaaatggtactgatcaaggggtagccgcggcagctgttgcaacggatgagttatataaaacatataatccaaataaaattgatggaacgtttttaacgaatcatgaccaaaatcgtgtaatgagtgagttaaatggtgatgtaaacaaagcaaaatcagcagcctctattctgttgacactccctggtaatccgttcatttattatggcgaagaaatcggcatgacaggccaaaaaccagatgagttgattcgtgagcctttccgttggtatgaagatgataaagaaggtcaaacgagctgggagactccagtatataacattgatcataatggtgtttcagttgaagcacaagataaacaaaaagcttctcttctaagccattatcgtaaaatgattcgtgttcgtcagcaacacgatgaacttgtcaaaggtaatttagaacctatttctgtcaataattcacaggttgttgcctataatcgtacgtataaaaataaatcaattcaagtgtaccataatatttcagacaagccggttacattaactgtttcaaacaaaggaaaactgattttttctagtgaattaggagcaaaaaaggaaaaatcaacattagtaattccagcgaatacgacagtgctagtaaagtaa

SEQ ID NO: 154 - protein, 539 aa, Environmental
MPSINASDCKKKGDRSMKRKKWTALALSLPLVMSLSTNIQAETLHNNKGQKAQTGNKDGIFYELYVNSFYDTDSNGHGDLKGVTKKLDYLNDGNPRTNNDLQINGIWMMPINTSPSYHKYDVTDYYNIDPQYGSLQDFRELTTEAHKRNVKVVIDLVINHTSSEHPWFVDALKNKNSKYRDYYIWADKNTDLNEKGPWGQQVWHKASNGEYFYATFWEGMPDLNYDNPKVREEMIKIGKFWLKQGADGFRLDAAMHIFKGQTPEGAKKNIEWWNEFRDAMRETNPNTYLVGEIWDQPEVVAPYYQSLDSTFNFDLAYKIVNSVKNGTDQGVAAAAVATDELYKTYNPNKIDGTFLTNHDQNRVMSELNGDVNKAKSAASILLTLPGNPFIYYGEEIGMTGQKPDELIREPFRWYEDDKEGQTSWETPVYNIDHNGVSVEAQDKQKASLLSHYRKMIRVRQQHDELVKGNLEPISVNNSQVVAYNRTYKNKSIQVYHNISDKPVTLTVSNKGKLIFSSELGAKKEKSTLVIPANTTVLVK

SEQ ID NO: 155 - DNA, 1773 bp, Environmental
gtgtcaagaatgtttgcaaaacgattcaaaacctctttactgccgttattcgctggatttttattgctgtttcatttggttctggcaggaccaacggctgcgaatgctgaaacggctaacaaatcaaatgagcttacagcaccgtcgatcaaaagcggaaccattcttcatgcttggaattggtcgttcaatacgttaaaacacaatatgaaggatattcatgatgcaggatatacagcgattcagacgtctccgattaaccaagtcaaggaagggaaccaaggaaataaaaacatgtcgaactggtactggctctatcagccgacatcgtaccaaattggcaaccgttacttaggtactgaacaagaatttaaagaaatgtgtgcagccgctgaagaatatggcataaaggttattgttgacgcggtcatcaatcataccaccagtgactatgccgcgatttccaatgagattaagagtattccaaactggacacatggaaacacacaaattaaaaactggtctgatcgatgggatgtcacgcagaatgcattgctcgggctgtatgactggaatacacaaaatacacaagtacagtcctatttgaaacggttcttagaaagagcattgaatgacggggcagacggttttcgatttgatgccgccaaacatatagagcttccggatgatggcagttacggcagtcaattttggccgaatatcacaaatacatctgcagagttccaatacggagaaatcctgcaggatagtgcttcaagagatgcttcatatgcgaattatatgaatgtgacagcgtctaactatgggcattccataaggtccgctttaaagaatcgtaatctgggcgtgtcgaatatctcccactatgcatcagatgtgtctgcggacaagctagtgacatgggtagaatcgcatgatacgtatgccaatgatgatgaagagtcgacatggatgagcgatgatgatatccgtttaggctgggcggtgatagcttctcgttcaggcagtacgcctcttttcttttccagacctgagggaggcggaaatggtgtgagattcccggggaaaagccaaataggcgatcgcgggagtgctttatttgaagatcaggctatcactgcggtcaatagatttcacaatgtgatggctggacagcctgaggaactctcgaacccaaatggaaacaaccagatatttatgaatcagcgcggctcacatggcgttgtgctggcaaatgcaggttcatcctctgtttctatcaatacgccaacaaaattgcctgatggcaggtatgataataaagctggggcaggttcatttcaagtaaatgacggtaaactgacaggcacgatcaatgccaggtctgtggctgtgctttatcctgatgatattgcaaaagcgcctcatgttttccttgagaattacaaaacaggtgtaacacattctttcaatgatcaactgacgattacactgcgtgcagatgcgaatacaacaaaagccgtttatcaaatcaataatggaccagagacggcgtttaaggatggagatcaattcacaatcggaaaaggagatccatttggcaaaacatacaccatcatgttaaaaggaacgaacagtgatggtgtaacgaggaccgaggaatacagttttgttaaaagagatccagcttcggccaaaaccatcggctatcaaaatccgaatcattggagccaggtaaatgcttatatctataaacatgatgggggccgggca

SEQ ID NO: 156 - protein, 591 aa, Environmental
VSRMFAKRFKTSLLPLFAGFLLLFHLVLAGPTAANAETANKSNELTAPSIKSGTILHAWNWSFNTLKHNMKDIHDAGYTAIQTSPINQVKEGNQGNKNMSNWYWLYQPTSYQIGNRYLGTEQEFKEMCAAAEEYGIKVIVDAVINHTTSDYAAISNEIKSIPNWTHGNTQIKNWSDRWDVTQNALLGLYDWNTQNTQVQSYLKRFLERALNDGADGFRFDAAKHIELPDDGSYGSQFWPNITNTSAEFQYGEILQDSASRDASYANYMNVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRGSHGVVLANAGSSSVSINTPTKLPDGRYDNKAGAGSFQVNDGKLTGTINARSVAVLYPDDIAKAPHVFLENYKTGVTHSFNDQLTITLRADANTTKAVYQINNGPETAFKDGDQFTIGKGDPFGKTYTIMLKGTNSDGVTRTEEYSFVKRDPASAKTIGYQNPNHWSQVNAYIYKHDGGRA

SEQ ID NO: 157 - DNA, 1596 bp, Environmental
atgcaaacgattgcaaaaaaaggggatgaaacgatgaaagggaaaaaatggacagcattagctctaacactgccgctggctgctagcttatcaacaggcgttcacgccgaaaccgtacataaaggtaaagctccaacagcagataaaaacggtgtcttttatgaggtgtatgtaaactctttttacgatgcaaataaagatggacatggtgatttaaaaggtcttacacaaaagctggattatttgaatgacggcaattctcataccaaaaatgatcttcaagtaaacggaatttggatgatgccggtaaacccttctcctagctatcataaatatgatgtaacggactattataacattgatccgcagtacggaaatctgcaagattttcgcaagctgatgaaagaagcagataaacgagacgtaaaggttattatggacctcgttgtgaatcatacaagcagtgaacatccttggtttcaagctgcattaaaagataaaaacagcaagtacagagattactatatttgggccgataaaaatactgatttaaatgaaaaaggatcttgggggcagcaagtatggcataaagctccaaacggagagtatttttatggtacgttttgggaaggaatgcctgacttaaattacgataatcccgaagtaagaaaagaaatgattaacgtcgggaaattttggctaaagcaaggcgttgacgggttccgcttagatgctgcgcttcatatttttaaaggtcaaacacctgaaggcgctaagaaaaatatcgtgtggtggaatgagtttagagatgcaatgaaaaaagaaaaccctaacgtatatctaacgggtgaagtatgggatcaaccggaagtagtagctccttactatcaatcgcttgattctttatttaactttgatttagcaggaaagattgtaaactctgtaaaatcaggaaatgatcaaggaatcgcgactgcagcagccgcaactgatgagctgttcaaatcatacaatccaaataaaattgacggcattttcttaaccaaccatgaccaaaatcgcgtcatgagtgagctaagcggcgatgtgaataaagcaaagtcagctgcctctatcttacttacgcttcctggcaacccgtatatttattacggtgaagaaattggaatgaccggtgaaaagcctgatgagttaatccgtgaaccgttccgctggtacgaaggcaatggacttggacaaaccagctgggaaacatccgtatacaacaaaggcggcaatggtgtgtcagtagagacacaaacaaaacaaaaggattctttgttaaatcattaccgtgaaatgattcgcgtgcgtcagcagcatgaagagttagtaaaaggaacccttcaatctatttcagtagacagtaaagaagtcgttgcctatagccgcacgtataaaggcaaatcgattagcgtgtatcataatatttcaaatcaaccggtaaaagtatctgtaacagcgaaaggtaaattgatttttgctagtgaaaaaggtgcaaaaaaagtcaaaaatcagcttgtggttccagctaatacaacggttttaataaaataa

SEQ ID NO: 158 - protein, 531 aa, Environmental
MQTIAKKGDETMKGKKWTALALTLPLAASLSTGVHAETVHKGKAPTADKNGVFYEVYVNSFYDANKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVDGFRLDAALHIFKGQTPEGAKKNIVWWNEFRDAMKKENPNVYLTGEVWDQPEVVAPYYQSLDSLFNFDLAGKIVNSVKSGNDQGIATAAAATDELFKSYNPNKIDGIFLTNHDQNRVMSELSGDVNKAKSAASILLTLPGNPYIYYGEEIGMTGEKPDELIREPFRWYEGNGLGQTSWETSVYNKGGNGVSVETQTKQKDSLLNHYREMIRVRQQHEELVKGTLQSISVDSKEVVAYSRTYKGKSISVYHNISNQPVKVSVTAKGKLIFASEKGAKKVKNQLVVPANTTVLIK

SEQ ID NO: 159 - DNA, 1587 bp, Environmental
atgcaaaaaaaaggggatgaaacgatgaaagggaaaaaatggacagctttagctctaacactgccgctggctgctagcttatcaacaggcgttcacgccgaaaccgtacataaaggtaaatctccaacagcagataaaaacggtgtattttatgaggtgtatgtaaactctttttacgatgcaaataaagatggacatggtgatttaaaaggtcttacacaaaagttggattatttaaatgatggcaattctcatacaaagaatgatcttcaagtaaacgggatttggatgatgccggtcaacccttctcccagctatcataaatatgatgtaacggactattataatattgatccgcagtatggaaatctgcaagattttcgcaaactgatgaaagaagcagataaacgagatgtaaaagtcattatggacctcgttgtgaatcatacgagcagtgaacacccttggtttcaagctgcattaaaagataaaaacagcaagtacagagattactatatctgggctgataaaaataccgacttgaatgaaaaaggatcttggggacagcaagtatggcataaagctccaaacggagagtatttttacggaacgttttgggaaggaatgccggacttaaattacgataatcctgaagtaagaaaagaaatgattaacgtaggaaagttttggctaaagcaaggagttgatgggttccgtctagatgctgcgcttcatatttttaaaggccaaacacctgaaggcgctaagaaaaatctcctgtggtggaatgaatttagagatgcaatgaaaaaggaaaaccctaacgtatatctaacgggtgaagtatgggatcaaccggaagtagtagctccttactatcaatcgcttgattctttatttaactttgatttagcaggaaagattgtaaactctgtaaaatcaggaaatgatcaaggaatcgcgactgcagcagcggcaacggatgaactgttcaaatcatacaatccaaataaaattgacggtattttcttaaccaaccatgaccaaaatcgcgtcatgagtgagctaaacggcgatgtgaataaagcaaagtcagctgcctctatcttacttacgcttcctggcaacccgtatatttattacggtgaagaaatcggcatgaccggtgaaaagcctgatgagttaatccgtgaaccgttcccctggtacgaaggaaacggacttggacaaaccagctgggaaacacctgtatataacaaaggcggcaacggcgtgtctgtagaagcacaaacaaaacaaaaggactctttgttaaatcattaccgtgaaatgattcgcgtgcgtcagcagcacgaagagttagtaaaaggaacgcttcaatctatttcagtagacagtaaagaagtcgttgcctatagccgtacgtataaaggcaaatcgattagcgtgtatcataatatttcaaatcaaccggtaaaagtatctgtagcagcaaaaggtaaattgatttttgctagtgaaaaaggtgctaagaaagtcaaaaatcagcttgtgattccggcgaatacaacggttttaataaaataa

SEQ ID NO: 160 - protein, 528 aa, Environmental
MQKKGDETMKGKKWTALALTLPLAASLSTGVHAETVHKGKSPTADKNGVFYEVYVNSFYDANKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVDGFRLDAALHIFKGQTPEGAKKNLLWWNEFRDAMKKENPNVYLTGEVWDQPEVVAPYYQSLDSLFNFDLAGKIVNSVKSGNDQGIATAAAATDELFKSYNPNKIDGIFLTNHDQNRVMSELNGDVNKAKSAASILLTLPGNPYIYYGEEIGMTGEKPDELIREPFPWYEGNGLGQTSWETPVYNKGGNGVSVEAQTKQKDSLLNHYREMIRVRQQHEELVKGTLQSISVDSKEVVAYSRTYKGKSISVYHNISNQPVKVSVAAKGKLIFASEKGAKKVKNQLVIPANTTVLIK

SEQ ID NO: 161 - DNA, 1623 bp, Bacterial
gtggatccaaagaattgtagtcaatttatgcaaacgattgcaaaaaaaggggatgaaacgatgaaagggaaaaaatggacagctttagctctaacactgccgctggctgctagcttatcaacaggtgttcacgccgaaaccgtacataaaggtaaagctccaacagcagataaaaacggtgtcttttatgaggtatatgtaaactctttttacgatgcaaataaagatggacatggtgatttaaaaggccttacacaaaagttggactatttaaatgacggaaattctcatacaaagaatgatcttcaagtaaacgggatttggatgatgccggtcaacccttctcctagctatcataaatatgatgtaacggactattataatattgatccgcagtatggaaatctgcaagattttcgcaaacttatgaaagaagcagataaacgagacgtaaaagtcattatggaccttgttgtgaatcatacgagcagtgaacacccttggtttcaagctgcgttgaaagataaaaacagcaagtacagagattactatatttgggctgataaaaatactgacttgaatgaaaaaggatcttggggacaacaagtatggcataaagctccaaacggagagtatttttacggaacgttctgggaaggaatgcctgacttaaattacgataaccctgaagtaagaaaagaaatgattaacgtcggaaagttttggctaaaacaaggcgttgacggcttccgcttagatgctgcccttcatatttttaaaggtcaaacgcctgaaggcgctaagaaaaacattctatggtggaatgagtttagagatgcgatgaaaaaagaaaacccgaacgtatatctaacgggtgaagtgtgggaccagccagaagtagtagccccttactatcaatcacttgattctctatttaattttgatttagcaggaaaaattgtcagctctgtaaaagcaggaaatgatcaaggaatcgccactgcagcagcggcaactgatgagctgttcaaatcatacaatccaaataaaattgacggcattttcttaaccaaccatgaccaaaatcgcgtcatgagtgagttaagcggcgatgtgaataaagcaaaatcagccgcctctatcttacttacgcttcctggaaatccgtatatttattacggtgaagaaattggcatgacaggtgaaaagcctgatgaattaatccgtgaaccgttccgctggtacgaaggcaacggaattggacaaactagctgggaaacacctgtatataacaaaggcggtaacggcgtgtctgtagaagcacaaacaaaacaaaaggattccttgttaaatcattaccgtgaaatgattcgtgtgcgccagcagcacgaagagttagtaaaaggaacgcttcaatccatttcagtagacagtaaagaagtcgttgcctatagccgcacgtacaaaggcaaatcgattagcgtgtatcataatatttcaaatcaacctgtaaaagtatctgtagcagcgaaaggtaacttgatttttgctagtgaaaaaggtgctaagaaagtcaaaaatcagcttgtgattccggcgaatgcgacggttttaataaaataa

SEQ ID NO: 162 - protein, 540 aa, Bacterial
VDPKNCSQFMQTIAKKGDETMKGKKWTALALTLPLAASLSTGVHAETVHKGKAPTADKNGVFYEVYVNSFYDANKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVDGFRLDAALHIFKGQTPEGAKKNILWWNEFRDAMKKENPNVYLTGEVWDQPEVVAPYYQSLDSLFNFDLAGKIVSSVKAGNDQGIATAAAATDELFKSYNPNKIDGIFLTNHDQNRVMSELSGDVNKAKSAASILLTLPGNPYIYYGEEIGMTGEKPDELIREPFRWYEGNGIGQTSWETPVYNKGGNGVSVEAQTKQKDSLLNHYREMIRVRQQHEELVKGTLQSISVDSKEVVAYSRTYKGKSISVYHNISNQPVKVSVAAKGNLIFASEKGAKKVKNQLVIPANATVLIK

SEQ ID NO: 163 - DNA, 1422 bp, Environmental
atggtacgtcccgaacgacgggctgcattggaaccgactatcgaacgactcgcagcacttgaaagacattgggtgacgacggtgtggattccgccggcgtacaaaggcacgtcacagaacgatgtcgggtatggggcgtacgatttatacgatctcggcgaattcaaccaaaaagggacgacccggacgaagtacgggacgaaagcgcagctccagaccgccatctcgaacttgcgcggtaaagggatcggtgtgtacggcgacgtcgtcatgaatcacaagggcggggccgattataccgaatccgttcaggcgatcgaggtcaatccgtcgaaccggaaccaagaaacgtccggtgagtatggcatctcggcctggactgggttcaacttcgcggggcgcaacaatacatactcgccgttcaaatggcgctggtaccattttgacggtaccgattgggatcagtcacgcagcttgagccgcatctataagttcaagagcacaggcaaggcgtgggacacggacgtgtcgaacgagaacggcaactatgattatcttatgtatgccgacgtcgatttcgagcatcccgaggtccgccaagagatgaagaactggggcaaatggtacgccgactcgctcgggctcgacggtttccggttggatgcggtcaaacatatcagccactcgtacttgaaggagtgggtgacgagcgtgcgccagacgaccgggaaagagatgttcacggtcgccgagtattggaagaacgatctcggtgccatcaacgactatctgtataagacgggctacacgcactccgtcttcgatgtgccgctccattataacttccaagcggccggtaacggcggcgggtattacgatatgcgcaacatcttgaaaggcaccgtcaccgaacagcatccgtcgctgtccgtgacgattgtcgataaccacgactcacagccgggccagtcgctcgagtcgacggtcgccaactggttcaaaccgctcgcctacgcgacgatcatgacgcgcggtcagggttatccggccctcttctatggagactattatggcacgaaagggacgacgaaccgcgaaatcccgaacatgtcgggcacgctccaaccgattttgaaggcacgaaaagacttcgcctacgggacgcagcatgactacctcgatcatcaggacgtcatcggctggacacgtgaaggtgtgaccgaccgtgccaaatcgggtctcgcgacgattctatcggacggtccgggcggctcgaagtggatgtacgtcggcaaacagaacgccggcgaggtatggaaagacatgacgaacaacaacgcccgtctcgtcacgatcaatgctgacggctggggtcagttcttcgtcaacggaggctcggtctcgatttatacgcaacaataa

SEQ ID NO: 164 - protein, 473 aa, Environmental
MVRPERRAALEPTIERLAALERHWVTTVWIPPAYKGTSQNDVGYGAYDLYDLGEFNQKGTTRTKYGTKAQLQTAISNLRGKGIGVYGDVVMNHKGGADYTESVQAIEVNPSNRNQETSGEYGISAWTGFNFAGRNNTYSPFKWRWYHFDGTDWDQSRSLSRIYKFKSTGKAWDTDVSNENGNYDYLMYADVDFEHPEVRQEMKNWGKWYADSLGLDGFRLDAVKHISHSYLKEWVTSVRQTTGKEMFTVAEYWKNDLGAINDYLYKTGYTHSVFDVPLHYNFQAAGNGGGYYDMRNILKGTVTEQHPSLSVTIVDNHDSQPGQSLESTVANWFKPLAYATIMTRGQGYPALFYGDYYGTKGTTNREIPNMSGTLQPILKARKDFAYGTQHDYLDHQDVIGWTREGVTDRAKSGLATILSDGPGGSKWMYVGKQNAGEVWKDMTNNNARLVTINADGWGQFFVNGGSVSIYTQQ

SEQ ID NO: 165 - DNA, 1437 bp, Bacterial
atgcagtatttcgagtggtacgtgccaaatgatggggaacattggaatcgtttgcgtaatgatgctgaaaatttagctcataaaggaattacatctgtatggataccacccgtatataaaggaacttcacaaaatgatgtagggtatggagtgtatgatgtatatgatttgggagaattcaatcaaaaaggaacgatacggacaaaatatgggacaaaagcacaattaaaatctgcaattgaggctttacataatcaaaatatcgatgtatacggtgatgttgttatgaaccataaaggtggggcagattatactgaggttgtaacagccgttgaggtagaccgtaacaatcgaaatattgaaacatcgagtgattatcaaatagatgcgtggacgggatttgattttccaggacgcagggactcctattctaattttaaatggagatggtttcattttgatggaacagattgggatgagggaaggaaattaaatagaatttataaatttaaaggcgtaggtaaagcttgggactgggaagtgtctagtgagaatggtaactatgattatttaatgtatgcagatcttgatttcgatcatcctgaagttgcaaatgaaatgaaaaactggggaacctggtatgcggacgaattaaatttagatggctttcgtttagacgcagttaaacatattgaccatgagtatcttcgtgattgggtaaatcatgttagaaagcaaacggggaaggaaatgtttacagtagctgaatattggcaaaatgatattcgtactttaaacaattatttagggaaagtaaattataatcaatctgtgttcgatgcacctcttcattataattttcattatgcttcaacagggaatggaaattatgatatgaggaatattttaaagggtacggtagtagaaagtcatcctacacttgctgttactcttgttgagaatcatgattctcagcctggacagtcattagaatctgttgtgagtccttggtttaagccgttggcctatgcatttattttaacgcgtgcagaagggtatccttctgttttttatggagattactatggcacaaatggaaatagtagttatgaaattccaacgttaaaggataaaattgatccaattctgacggcacgaaaaaactttgcatatggtacgcaacatgattatttagaccatccagatgtgattggctggacaagagaaggggatagtatacatgctaattctggtttagcaacattaatctctgatggaccaggaggatcaaaatggatgaatgttggaaagaacaacgcaggggaaatatggtacgatattacgggcaatcaaacaaatactgtaacgattaataaagatggatgggggcagttccatgtaaatgggggctctgtttcaatatatgttcagaagtaa

SEQ ID NO: 166 - protein, 478 aa, Bacterial
MQYFEWYVPNDGEHWNRLRNDAENLAHKGITSVWIPPVYKGTSQNDVGYGVYDVYDLGEFNQKGTIRTKYGTKAQLKSAIEALHNQNIDVYGDVVMNHKGGADYTEVVTAVEVDRNNRNIETSSDYQIDAWTGFDFPGRRDSYSNFKWRWFHFDGTDWDEGRKLNRIYKFKGVGKAWDWEVSSENGNYDYLMYADLDFDHPEVANEMKNWGTWYADELNLDGFRLDAVKHIDHEYLRDWVNHVRKQTGKEMFTVAEYWQNDIRTLNNYLGKVNYNQSVFDAPLHYNFHYASTGNGNYDMRNILKGTVVESHPTLAVTLVENHDSQPGQSLESVVSPWFKPLAYAFILTRAEGYPSVFYGDYYGTNGNSSYEIPTLKDKIDPILTARKNFAYGTQHDYLDHPDVIGWTREGDSIHANSGLATLISDGPGGSKWMNVGKNNAGEIWYDITGNQTNTVTINKDGWGQFHVNGGSVSIYVQK

SEQ ID NO: 167 - DNA, 1596 bp, Environmental
atgcaaacgattgcaaaaaaaggggatgaaacgatgaaagggaaaaaatggacagctttagctctaacactgccgctggctgctagcttatcaacaggcgttcacgccgaaaccgtacataaaggtaaatctccaacagcagataaaaacggtgtattttatgaggtgtatgtaaactctttttacgatgcaaataaagatggacatggtgatttaaaaggtcttacacaaaagttggattatttaaatgatggcaattctcatacaaagaatgatcttcaagtaaacgggatttggatgatgccggtcaacccttctcccagctatcataaatatgatgtaacggactattataatattgatccgcagtatggaaatctgcaagattttcgcaaactgatgaaagaagcagataaacgagatgtaaaagtcattatggacctcgttgtgaatcatacgagcagtgaacacccttggtttcaagctgcattaaaagataaaaacagcaagtacagagattactatatctgggctgataaaaataccgacttgaatgaaaaaggatcttggggacagcaagtatggcataaagccccaaacggagagtatttttacggaacgttttgggaaggaatgccggacttaaattacgataatcctgaagtaagaaaagaaatgattaacgtaggaaagttttggctaaagcaaggagttgacgggttccgtctagatgctgcgcttcatatttttaaaggccaaacacctgaaggcgctaagaaaaatctcctgtggtggaatgaatttagagatgcaatgaaaaaggaaaaccctaacgtatatctaacgggtgaagtatgggatcaaccggaagtagtagctccttactatcaatcgcttgattctttatttaactttgatttagcaggaaagattgtaaactctgtaaaatcaggaaatgatcaaggaatcgcgactgcagcagcggcaacggatgaactgttcaaatcatacaatccaaataaaattgacggtattttcttaaccaaccatgaccaaaatcgcgtcatgagtgagctaagcggcgatgtgaataaagcaaagtcagctgcctctatcttacttacgcttcctggcaacccgtatatttattacggtgaagaaatcggcatgaccggtgaaaagcctgatgagttaatccgtgaaccgttccgctggtacgaaggaaacggacttggacaaaccagctgggaaacacctgtatacaacaaaggcggcaacggcgtgtctgtagaagcacaaacaaaacaaaaggactctttgttaaatcattaccgtgaaatgattcgcgtgcgtcagcagcacgaagagttagtaaaaggaacgcttcaatctatttcagtagacagtaaagaagtcgttgcctatagccgcacgtataaaggcaaatcgattagcgtgtatcataatatttcaaatcaaccggtaaaagtatctgtagcagcaaaaggtaaattgatttttggtagtgaaaaaggtgctaagaaagtcaaaaatcagcttgtgattccggcgaatacaacggttttaataaaataa

SEQ ID NO: 168 - protein, 531 aa, Environmental
MQTIAKKGDETMKGKKWTALALTLPLAASLSTGVHAETVHKGKSPTADKNGVFYEVYVNSFYDANKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVDGFRLDAALHIFKGQTPEGAKKNLLWWNEFRDAMKKENPNVYLTGEVWDQPEVVAPYYQSLDSLFNFDLAGKIVNSVKSGNDQGIATAAAATDELFKSYNPNKIDGIFLTNHDQNRVMSELSGDVNKAKSAASILLTLPGNPYIYYGEEIGMTGEKPDELIREPFRWYEGNGLGQTSWETPVYNKGGNGVSVEAQTKQKDSLLNHYREMIRVRQQHEELVKGTLQSISVDSKEVVAYSRTYKGKSISVYHNISNQPVKVSVAAKGKLIFGSEKGAKKVKNQLVIPANTTVLIK

SEQ ID NO: 169 - DNA, 1524 bp, Environmental
atgaaaacattcaaattaaaacgcacttttttaccgctaaccttgctgctcagtgctcctgcctttgctgggcaaaatggcaccatgatgcagtattttcattggtatgtacctaatgatggcgcattatggacgcaggttgaaagcaatgctccagcactcgctgaaaacggttttacagcgctctggctaccgccagcttacaaaggcgcgggcggcagtaatgacgtcggttatggcgtctatgatatgtacgatttaggtgagtttgatcaaaaaggctcagtacgaaccaaatacggcaccaaggctcagtacatctctgcaatcaatgccgcgcacaacaacaatatccaaatctacggcgatgttgtgtttaaccaccgaggtggtgctgatgggaagtcgtgggtcgataccaagcgcgttgattgggacaaccgtaacattgaactgggcgacaaatggattgaagcttgggttgagtttaattttcctggccgcaacgacaaatactcaaacttccattggacttggtatcactttgacggtgttgactgggatgatgccggcaaagaaaaagcgatctttaaattcaaaggcgaaggaaaagcatgggattgggaagtcagctctgaaaaaggcaattacgactacctaatgtacgccgatttagacatggatcaccaagaagttaaacaagagctgaaagattggggtgagtggtacatcaacatgaccggcgttgatggctttagaatggatgccgtgaagcacattaaatatcagtatctacaagagtggattgatcatttacgttggaaaacaggcaaagagcttttcaccgttggtgagtattggaattacgacgtaaatcaactgcataactttattactaagacctctggcagtatgtcgttgttcgatgcgccgcttcacatgaacttctacaacgcgtcaaaatctggcggcaattacgatatgcgccaaatcatgaatggcacgttgatgaaggacaacccagtcaaagctgtgactctcgtagaaaaccacgatacacagccattgcaggcgttagagtcgacagtggattggtggttcaagcctcttgcttacgcattcattttattgcgtgaagaaggttatccatcagtgttctacgcagattactacggcgcgcagtacagcgacaaaggctacaacatcaatatggccaaagttccttacattgaagaacttgtaacactgcgtaaagagtatgcgtatggcaaacagaattcttatctcgaccactgggatgtgattggctggacccgagagggcgatgctgaacatccaaactcaatggcggtgatcatgagtgatggaccaggtggcaaaaaatggatgtataccggtaagccaagcacgcgctatgtcgacaagctgggtatccgaactgaagaagtttggaccgataccaatggctgggcagaatttcctgtcaatggtggttcagtctcggtttgggtgggcgttaagtaa

SEQ ID NO: 170 - protein, 507 aa, Environmental
MKTFKLKRTFLPLTLLLSAPAFAGQNGTMMQYFHWYVPNDGALWTQVESNAPALAENGFTALWLPPAYKGAGGSNDVGYGVYDMYDLGEFDQKGSVRTKYGTKAQYISAINAAHNNNIQIYGDVVFNHRGGADGKSWVDTKRVDWDNRNIELGDKWIEAWVEFNFPGRNDKYSNFHWTWYHFDGVDWDDAGKEKAIFKFKGEGKAWDWEVSSEKGNYDYLMYADLDMDHQEVKQELKDWGEWYINMTGVDGFRMDAVKHIKYQYLQEWIDHLRWKTGKELFTVGEYWNYDVNQLHNFITKTSGSMSLFDAPLHMNFYNASKSGGNYDMRQIMNGTLMKDNPVKAVTLVENHDTQPLQALESTVDWWFKPLAYAFILLREEGYPSVFYADYYGAQYSDKGYNINMAKVPYIEELVTLRKEYAYGKQNSYLDHWDVIGWTREGDAEHPNSMAVIMSDGPGGKKWMYTGKPSTRYVDKLGIRTEEVWTDTNGWAEFPVNGGSVSVWVGVK

SEQ ID NO: 171 - DNA, 1431 bp, Environmental
gtgtatgtaaactctttttacgatgcaaataaagatggacatggtgatttaaaaggtcttacacaaaagttggattatttaaatgatggcaattctcatacaaagaatgatcttcaagtaaacgggatttggatgatgccggtcaacccttctcccagctatcataaatatgatgtaacggactattataatattgatccgcagtatggaaatctgcaagattttcgcaaactgatgaaagaagcagataaacgagatgtaaaagtcattatggacctcgttgtgaatcatacgagcagtgaacacccttggtttcaagctgcattaaaagataaaaacagcaagtacagagattactatatctgggctgataaaaataccgacttgaatgaaaaaggatcttggggacagcaagtatggcataaagccccaaacggagagtatttttacggaacgttttgggaaggaatgccggacttaaattacgataatcctgaagtaagaaaagaaatgattaacgtaggaaagttttggctaaagcaaggagttgacgggttccgtctagatgctgcgcttcatatttttaaaggccaaacacctgaaggcgctaagaaaaatctcctgtggtggaatgaatttagagatgcaatgaaaaaggaaaaccctaacgtatatctaacgggtgaagtatgggatcaaccggaagtagtagctccttactatcaatcgcttgattctttatttaactttgatttagcaggaaagattgtaaactctgtaaaatcaggaaatgatcaaggaatcgcgactgcagcagcggcaacggatgaactgttcaaatcatacaatccaaataaaattgacggtattttcttaaccaaccatgaccaaaatcgcgtcatgagtgagctaagcggcgatgtgaataaagcaaagtcagctgcctctatcttacttacgcttcctggcaacccgtatatttattacggtgaagaaatcggcatgaccggtgaaaagcctgatgagttaatccgtgaaccgttccgctggtacgaaggaaacggacttggacaaaccagctgggaaacacctgtatacaacaaaggcggcaacggcgtgtctgtagaagcacaaacaaaacaaaaggactctttgttaaatcattaccgtgaaatgattcgcgtgcgtcagcagcacgaagagttagtaaaaggaacgcttcaatctatttcagtagacagtaaagaagtcgttgcctatagccgcacgtataaaggcaaatcgattagcgtgtatcataatatttcaaatcaaccggtaaaagtatctgtagcagcaaaaggtaaattgatttttggtagtgaaaaaggtgctaagaaagtcaaaaatcagcttgtgattccggcgaatacaacggttttaataaaataa

SEQ ID NO: 172 - protein, 476 aa, Environmental
VYVNSFYDANKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVDGFRLDAALHIFKGQTPEGAKKNLLWWNEFRDAMKKENPNVYLTGEVWDQPEVVAPYYQSLDSLFNFDLAGKIVNSVKSGNDQGIATAAAATDELFKSYNPNKIDGIFLTNHDQNRVMSELSGDVNKAKSAASILLTLPGNPYIYYGEEIGMTGEKPDELIREPFRWYEGNGLGQTSWETPVYNKGGNGVSVEAQTKQKDSLLNHYREMIRVRQQHEELVKGTLQSISVDSKEVVAYSRTYKGKSISVYHNISNQPVKVSVAAKGKLIFGSEKGAKKVKNQLVIPANTTVLIK

SEQ ID NO: 173 - DNA, 1596 bp, Environmental
atgcaaacgattgcaaaaaaaggggatgaaacgatgaaagggaaaaaatggacagctttagctctaacactgccgctggctgctagcttatcaacaggcgttcacgcagaaactgtacataaaggtaaagctccaacagcagataaaaacggtgttttttatgaggtgtatgtaaactctttttacgatgcaaataaagatggacatggtgatttaaaaggtctgacacaaaagttggattatttaaatgacggcaattctcatacaaagaatgatcttcaagtaaacgggatttggatgatgccggtaaacccttctcctagctatcataaatatgatgtaacggactattataacattgatcctcagtacggaagtctgcaagatttccgcaaactgatgaaagaagcagataaacgagacgtaaaagttattatggaccttgttgtgaatcatacgagcagtgaacacccttggtttcaagctgcactaaaagataaaaacagcaagtacagagattactatatttgggctgataaaaataccgatttgaatgaaaaaggatcttggggacagcaagtatggcataaagctccaaacggagagtatttttacggaacgttctgggaaggaatgcctgacttaaattacgataaccctgaagtaagaaaagaaatgattaacgtcggaaagttttggctaaagcaaggcgttgatggcttccgcttagatgctgcccttcatatctttaaaggtcaaactcctgaaggcgctaagaaaaatctcctgtggtggaatgagtttagagatgcaatgaaaaaagaaaaccctaacgtatatctaacgggtgaagtatgggatcagccggaagtagtagctccttattatcaatcgcttgattccctatttaactttgatttagcaggaaaaattgtcagctctgtaaaagcaggaaatgatcaaggaatcgccactgcagcagcggcaacggatgagctgttcaaatcatacaatccaaataaaattgacggcattttcttaaccaaccatgaccaaaaccgcgtcatgagtgagctaagcggagatgtgaataaagcaaaatcagctgcttctatcttacttacgcttcctggaaatccgtatatttattacggtgaagaaattggcatgaccggtgaaaagcctgatgaattaatccgtgaaccgttccgctggtacgaaggcaacggaattggacaaactagctgggaaacacctgtatataacaaaggcggcaatggtgtgtctgtagaagcacaaaccaaacaaaaggattctttgttaaatcattaccgtgaaatgattcgcgtgcgtcagcagcacgaagagttagtaaaaggaacgcttcagtctatttcagtagacagtaaagaagttgtcgcttatagccgtacgtataaaggcaactccattagtgtgtatcataatatttcaaatcaacctgtaaaagtatctgtagcggcgaaaggtaaattgatttttgctagtgaaaaaggtgctaaaaaaggcaaaaatcagcttgtgattccggcgaatgcgacggttttaataaaataa

SEQ ID NO: 174 - protein, 531 aa, Environmental
MQTIAKKGDETMKGKKWTALALTLPLAASLSTGVHAETVHKGKAPTADKNGVFYEVYVNSFYDANKDGHGDLKGLTQKLDYLNDGNSHTKNDLQVNGIWMMPVNPSPSYHKYDVTDYYNIDPQYGSLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVDGFRLDAALHIFKGQTPEGAKKNLLWWNEFRDAMKKENPNVYLTGEVWDQPEVVAPYYQSLDSLFNFDLAGKIVSSVKAGNDQGIATAAAATDELFKSYNPNKIDGIFLTNHDQNRVMSELSGDVNKAKSAASILLTLPGNPYIYYGEEIGMTGEKPDELIREPFRWYEGNGIGQTSWETPVYNKGGNGVSVEAQTKQKDSLLNHYREMIRVRQQHEELVKGTLQSISVDSKEVVAYSRTYKGNSISVYHNISNQPVKVSVAAKGKLIFASEKGAKKGKNQLVIPANATVLIK

SEQ ID NO: 175 - DNA, 1398 bp, Environmental
atgaaaaatataatacgactttgtgctgccagcgctatcctcacggtgtcccacgccagttacgccgacgcaattttacacgcgtttaactggcaatataccgatgtaaccgccaatgcaaatcaaattgccgcaaatggctttaaaaaagtcctcatttcacccgcaatgaaatccagcggcagtcaatggtgggcccgctatcaaccgcaagacttgcgtgtcattgattctccgctgggcaacaaacaagatttagtcgcgatgatcaatgcgctcaacagcgttggggtcgacgtgtatgctgacgtggtgcttaaccatatggctaacgagtcatggaagcgcagtgacctgaactacccggggagtgaggtgctcaacgactatcaatcccgcagtgcttactatcaaaggcaaacacttttcggcaatttacaggagaaccttttttccgagaatgatttccatccggcaggctgtattaccaattggaatgatcctggccacgtccagtattggcgcttgtgcggcggacagggcgatactgggctaccggatctcgatcctaatcaatgggttgtgagtcagcagaagagttacttgaacgcactcaaatcaatgggaatcaaagggttccgtatcgatgcggtcaaacatatgagtcaatatcaaatagaccaagtgtttaccccagacattaccgctggtatgcatatattcggagaagtcattaccagtggtgggcaaggtgatagcggctatgaggcttttcttgccccttaccttaataataccgatcacgccgcttatgacttcccgctatttgcatcgattcgagccgcgttttcattctctggtgggttaaatcagctacacaatccacaagcctatggccaagcgttacaggactcacgtgcgatcacctttacgattacccacgacattccaaccaatgacggtttccgctaccagatcatggatccaaccgatgaacagctcgcctatgcctacatcttgggcaaagatggaggaacgccacttgtctatagtgatgacctacctgacagcgaagacaaagacagtggtcgttgggccgatgtgtggcaagatccgaacatgattaacatgcttgccttccacaacgcgatgcaaggacaaagcatgactgtagtggctagcgatcaatgtaccttgctatttaagcgcggcaagcaaggcgtggtaggaatcaataaatgtggcgagagtaagtcggtgactgtcgatacttaccagcatgagtttaactggtacaccccgtaccaagacgtattgagcggcgacatcaccacagtgagttctcgttatcaccaatttgttttgccagcgcgcagtgcaaggatgtggaaactataa

SEQ ID NO: 176 - protein, 465 aa, Environmental
MKNIIRLCAASAILTVSHASYADAILHAFNWQYTDVTANANQIAANGFKKVLISPAMKSSGSQWWARYQPQDLRVIDSPLGNKQDLVAMINALNSVGVDVYADVVLNHMANESWKRSDLNYPGSEVLNDYQSRSAYYQRQTLFGNLQENLFSENDFHPAGCITNWNDPGHVQYWRLCGGQGDTGLPDLDPNQWVVSQQKSYLNALKSMGIKGFRIDAVKHMSQYQIDQVFTPDITAGMHIFGEVITSGGQGDSGYEAFLAPYLNNTDHAAYDFPLFASIRAAFSFSGGLNQLHNPQAYGQALQDSRAITFTITHDIPTNDGFRYQIMDPTDEQLAYAYILGKDGGTPLVYSDDLPDSEDKDSGRWADVWQDPNMINMLAFHNAMQGQSMTVVASDQCTLLFKRGKQGVVGINKCGESKSVTVDTYQHEFNWYTPYQDVLSGDITTVSSRYHQFVLPARSARMWKL

SEQ ID NO: 177 - DNA, 1524 bp, Environmental
atgaaaacattcaaattaaaacgcacttttttaccgctgaccttgctgctcagtgctcctgcctttgctgggcaaaatggcaccatgatgcagtattttcattggtacgtacctaatgatggcgcattatggacgcaggttgaaagcaatgctccagtactcgctgaaaacggttttacagcgctctggctaccgcccgcatacaaaggcgcgggcggcagtaatgacgtcggttatggcgtctatgatatgtacgatttaggtgagtttgaccaaaaaggctcagtacgaaccaaatacggcaccaaggctcagtacatctctgcaatcaatgccgcgcacaacaacaatatccaaatttacggcgacgttgtgtttaaccaccgaggtggcgctgatgggaagtcgtgggtcgataccaagcgcgttgattgggacaaccgcaatattgaactgggcgacaaatggattgaagcttgggttgagtttaattttcctggccgcaacgacaaatactcgaacttccattggacttggtatcactttgacggtgttgactgggatgatgccggcaaagaaaaagcgatctttaaattcaaaggcgaaggaaaagcatgggattgggaagtcagctctgaaaaaggcaattacgactacctaatgtacgccgatttagacatggatcacccagaagttaaacaagagctgaaagattggggtgagtggtacatcaacatgaccggcgttgatggctttagaatggatgccgtgaagcacattaaatatcagtatctacaagagtggattgatcatttacgttggaaaacaggcaaagagcttttcaccgttggtgagtattggaattacgacgtaaatcaactgcacaactttattactaagacctctggcagtatgtcgttgttcgatgcgccgcttcacatgaatttctacaacgcgtcaaaatctggcggcacttacgatatgcgccaaatcatgaatggcacgttgatgaaggacaacccagtcaaagcagtgactctcgtagaaaaccacgatacgcagccattgcaggcgttagagtcgacagtagattggtggttcaagcctcttgcttacgcattcattttattgcgtgaagaaggttatccatcggtgttctacgcagattactacggcgcgcagtacagcgacaaaggttacaacattaatatggccaaagtgccttacattgaagaacttgtaacactgcgtaaagagtatgcgtatggcaaacagaattcttatctcgaccattgggatgtgattggctggacccgagagggcgatgctgaacatccaaactcaatggcggtgatcatgagtgatggaccgggcggcacaaaatggatgtataccggtaagccaagtacgcgctatgtcgacaagctgggtatccgaactgaagatgtttggaccgatgccaatggctgggcagaatttcctgtcaatggtggttcagtctcggtttgggtgggcgttaagtaa

SEQ ID NO: 178 - protein, 507 aa, Environmental
MKTFKLKRTFLPLTLLLSAPAFAGQNGTMMQYFHWYVPNDGALWTQVESNAPVLAENGFTALWLPPAYKGAGGSNDVGYGVYDMYDLGEFDQKGSVRTKYGTKAQYISAINAAHNNNIQIYGDVVFNHRGGADGKSWVDTKRVDWDNRNIELGDKWIEAWVEFNFPGRNDKYSNFHWTWYHFDGVDWDDAGKEKAIFKFKGEGKAWDWEVSSEKGNYDYLMYADLDMDHPEVKQELKDWGEWYINMTGVDGFRMDAVKHIKYQYLQEWIDHLRWKTGKELFTVGEYWNYDVNQLHNFITKTSGSMSLFDAPLHMNFYNASKSGGTYDMRQIMNGTLMKDNPVKAVTLVENHDTQPLQALESTVDWWFKPLAYAFILLREEGYPSVFYADYYGAQYSDKGYNINMAKVPYIEELVTLRKEYAYGKQNSYLDHWDVIGWTREGDAEHPNSMAVIMSDGPGGTKWMYTGKPSTRYVDKLGIRTEDVWTDANGWAEFPVNGGSVSVWVGVK

SEQ ID NO: 179 - DNA, 1524 bp, Environmental
atgaaaacattcaaattaaaacgcacttttttaccgctaaccttgctgctcagtgctcctgcctttgccgggcaaaatggcaccatgatgcagtactttcattggtacgtacctaatgatggcgcattatggacgcaggttgaaagcaatgctccagcactcgctgaaaacggttttacagcgctctggctaccgccagcttacaaaggcgcgggcggcagtaatgatgtcggttatggcgtctacgatatgtacgatttaggtgagtttgatcaaaaaggctcagtacgaaccaaatacggtaccaaggctcagtacatctctgcaatcaatgctgcgcacaacaacaatatccaaatttacggcgacgttgtgtttaaccatcgtggtggcgctgatgggaagtcgtgggtcgataccaagcgcgttgattgggacaaccgtaacattgaactgggcgacaaatggattgaagcttgggttgagtttaattttcctagccgcaacgacaaatactcgaacttccattggacttggtatcactttgacggtgttgactgggatgatgccggcaaagaaaaagcgatctttaaattcaaaggcgaaggaaaagcatgggattgggaagtcagctctgaaaaaggcaattacgactacctaatgtacgccgatttagacatggatcacccagaagttaaacaagagctgaaagattggggtgagtggtacatcaacatgaccggcgttgatggctttagaatggatgccgttaagcacattaaatatcagtatctacaagagtggattgatcatttacgttggaaaacaggcaaagagcttttcaccgttggtgagtattggaattacgacgtaaatcaactgcataactttattactaagacctctggcagtatgtcgttgttcgatgcgccgcttcacatgaacttctacaacgcgtcaaaatctggcggcaattacgatatgcgccaaatcatgaatggcacgttgatgaaggacaacccagtcaaagctgtgactctcgtagaaaaccacgatacgcagccattgcaggcgttagagtcgacagtggattggtggttcaagcctcttgcttacgcattcatcttgttgcgtgaagaaggttatccatcggtgttctacgcagattactacggcgcgcagtacagcgacaaaggttacaacattaatatggccaaagtgccttacattgaagaacttgtaacactgcgtaaagagtatgcgtatggcaaacagaattcttatctcgaccattgggatgtgattggctggactcgagagggcgatgctgaacatccaaactcaatggcggtgatcatgagtgatggaccgggcggaacaaaatggatgtataccggtaatccaagcacgcgctatgtcgacaagctgggtatccgaactgaagatgtttggaccgatgccaatggctgggcagaatttcctgtcaatggtggttcagtctcggtttgggtgggcgttaagtaa

SEQ ID NO: 180 - protein, 507 aa, Environmental
MKTFKLKRTFLPLTLLLSAPAFAGQNGTMMQYFHWYVPNDGALWTQVESNAPALAENGFTALWLPPAYKGAGGSNDVGYGVYDMYDLGEFDQKGSVRTKYGTKAQYISAINAAHNNNIQIYGDVVFNHRGGADGKSWVDTKRVDWDNRNIELGDKWIEAWVEFNFPSRNDKYSNFHWTWYHFDGVDWDDAGKEKAIFKFKGEGKAWDWEVSSEKGNYDYLMYADLDMDHPEVKQELKDWGEWYINMTGVDGFRMDAVKHIKYQYLQEWIDHLRWKTGKELFTVGEYWNYDVNQLHNFITKTSGSMSLFDAPLHMNFYNASKSGGNYDMRQIMNGTLMKDNPVKAVTLVENHDTQPLQALESTVDWWFKPLAYAFILLREEGYPSVFYADYYGAQYSDKGYNINMAKVPYIEELVTLRKEYAYGKQNSYLDHWDVIGWTREGDAEHPNSMAVIMSDGPGGTKWMYTGNPSTRYVDKLGIRTEDVWTDANGWAEFPVNGGSVSVWVGVK

SEQ ID NO: 181 - DNA, 1830 bp, Environmental
atgccagaggccttcggcctggccattacgccgtcacatagccggcgggggaggttggtgggcgtgtcgcgcgggggcagcctgccgatgccggtcctccactggccggcgttcatcctcgtccggcgcttcgtcgccggtcatccgaacaagcacaagaaccggagtattgcgatgagccacaccctgcgtgccgccgtattggcggcgatcctgctgccgttccccgccctcgctgaccaggccggcaagagcccggccggcgtgcgctaccacggcggcgacgaaatcatcctccagggcttccactggaacgtcgtccgcgaagcgcccaacgactggtacaacatccttcgccagcaggcctcgacgatcgccgcggacggcttctcggcaatctggatgccggtgccctggcgtgacttctccagctggaccgacggcggcaagtcaggcggcggcgaaggctacttctggcacgacttcaacaagaacggccgctacggcagcgacgcccagctgcgccaggccgccggcgcactcggtggcgccggggtgaaggtgctctacgatgtggtgcccaatcacatgaaccgcggctatccggacaaggagatcaacctgccggccggccagggcttctggcgcaacgactgcaccgacccgggcaactaccccaacgactgcgatgacggtgaccgcttcatcggcggcaagtcggacctgaacaccggccatccgcagatctacggcatgtttcgcgacgagcttgccaacctgcgcagcgggtacggcgccggcggcttccgcttcgacttcgttcgcggctatgcgcccgaacgggtcgacagctggatgagcgacagcgccgacagcagtttctgcgttggcgagctgtggaaaagcccgtccgagtacccgagctgggactggcgcaacacggcgagctggcagcagatcatcaaggactggtccgaccgggccaagtgcccggtgttcgacttcgcgctcaaggagcgcatgcagaacggctcggtcgccgactggaagcatggcctcaatggcaacccggacccgcgctggcgcgaggtggcggtgacctttgtcgacaaccacgacaccggctattcgcccgggcagaacggcggccagcaccactgggcgctgcaggacgggctgatccgccaggcctacgcctacatcctcaccagcccgggcacgccggtggtgtactggtcgcacatgtacgactggggctacggcgacttcattcgccagctgatccaggtgcggcgcaccgctggcgtgcgcgccgattcggcgatcagcttccacagcggctacagcggcctggtcgctaccgtcagcggcagccatcagaccctggtggtggcgctcaactccgatctggccaaccccggccaggtcgccagcggcagcttcagcgaggcggtcaacgccagcaacggccaggtgcgcgtctggcgcagcggtagcggcgatggcggcggcaatgacggcggcgagggcggtctggtcaatgtgaacttccgctgcgacaacggcgtgacgcagatgggcgacagcgtctacgcggtgggcaacgtcagccagctcggcaactggagcccggcctccgcggtacggctgaccgacaccagcagctatccgacctggaagggcagcatcgccctgcctgacggtcagaacgtggaatggaagtgcctgatccgtaacgaggcggacgcgacgctggtgcgccagtggcaatcgggcggcaacaaccaggtccaggccgctgccggcgcgagcaccagcggctcgttctga

SEQ ID NO: 182 - protein, 609 aa, Environmental
MPEAFGLAITPSHSRRGRLVGVSRGGSLPMPVLHWPAFILVRRFVAGHPNKHKNRSIAMSHTLRAAVLAAILLPFPALADQAGKSPAGVRYHGGDEIILQGFHWNVVREAPNDWYNILRQQASTIAADGFSAIWMPVPWRDFSSWTDGGKSGGGEGYFWHDFNKNGRYGSDAQLRQAAGALGGAGVKVLYDVVPNHMNRGYPDKEINLPAGQGFWRNDCTDPGNYPNDCDDGDRFIGGKSDLNTGHPQIYGMFRDELANLRSGYGAGGFRFDFVRGYAPERVDSWMSDSADSSFCVGELWKSPSEYPSWDWRNTASWQQIIKDWSDRAKCPVFDFALKERMQNGSVADWKHGLNGNPDPRWREVAVTFVDNHDTGYSPGQNGGQHHWALQDGLIRQAYAYILTSPGTPVVYWSHMYDWGYGDFIRQLIQVRRTAGVRADSAISFHSGYSGLVATVSGSHQTLVVALNSDLANPGQVASGSFSEAVNASNGQVRVWRSGSGDGGGNDGGEGGLVNVNFRCDNGVTQMGDSVYAVGNVSQLGNWSPASAVRLTDTSSYPTWKGSIALPDGQNVEWKCLIRNEADATLVRQWQSGGNNQVQAAAGASTSGSF

SEQ ID NO: 183 - DNA, 1596 bp, Environmental
atgcaaacgattgcaaaaaaaggggatgaaacgatgaaagggaaaaaatggacagctttagctctaacactgccgctggctgctagcttatcaacaggcgttcacgccgaaaccgtacataaaggtaagtctgaagcaacagataaaaacggtgtcttttatgaggtgtatgtaaactctttttacgatacaaataaagatggacatggtgatttaaaaggtctgacacaaaagttggattatttaaatgacggcaattctcatacaaagaatgatcttcaagtaaacgggatttggatgatgccagtcaacccttctcctagctatcataaatatgatgtaacggactattataacattgatcctcagtacggaaatctgcaagattttcgcaagctgatgaaagaagcagacaaacgagacgtaaaagtcattatggaccttgttgtgaatcatacgagcagcgaacacccttggtttcaagctgcattaaaagataaaaacagcaagtacagagattactatatttgggctgataaaaataccgatttgaatgaaaaaggatcttgggggcagcaagtatggcataaagctccaaacggagagtatttttacggaacgttttgggaaggaatgcctgacttaaattacgataaccctgaagtaagaaaagaaatgattaacgtcggaaagttttggctaaagcaaggcgttaatggcttccgcttagatgctgcgcttcatatttttaaaggtcaaacacctgaaggcgctaagaaaaatatcctgtggtggaatgagtttagagatgcgatgaaaaaagaaaaccctaacgtatatctaacgggtgaagtatgggatcagcctgaagtggtagctccttactatcaatcgcttgattctttatttaattttgatttagcaggaaaaattgtcagctctgtaaaagcaggaaatgatcaaggaatcgccactgcagcagcggcaacagatgaactgttcaaatcatacaatccaaataaaattgacggcattttcttaaccaaccatgaccaaaatcgcgtcatgagtgagctgagcggcgatgtgaacaaagcaaaatcagctgcttctatcttacttacgcttcctggcaacccgtatatttattacggtgaagaaattggcatgaccggtgaaaagcctgatgagttaatccgtgaaccattccgctggtacgaaggaaacggacttggacaaactagctgggaaacacctgtatataacaaaggcggcaacggcgtgtctgtagaagtacaaaccaaacaaaaggattctttgttaaatcattatcgtgaaatgattcgcgtgcgtcagcagcatgaagagttagtaaaaggaacgcttcaatctatttcagtagacagtaaagaagtggttgcctatagtcgcacgtataaaggcaactcgattagcgtgtatcataatatttcaaatcaacctgtaaaagtatctgtagcagcgaaaggtaaattgatttttgctagtgaaaaaggtgctaaaaaagtcaaaaatcagcttgtaattccggctaatacaacggttttaataaaataa

SEQ ID NO: 184 - protein, 531 aa, Environmental
MQTIAKKGDETMKGKKWTALALTLPLAASLSTGVHAETVHKGKSEATDKNGVFYEVYVNSFYDTNKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVNGFRLDAALHIFKGQTPEGAKKNILWWNEFRDAMKKENPNVYLTGEVWDQPEVVAPYYQSLDSLFNFDLAGKIVSSVKAGNDQGIATAAAATDELFKSYNPNKIDGIFLTNHDQNRVMSELSGDVNKAKSAASILLTLPGNPYIYYGEEIGMTGEKPDELIREPFRWYEGNGLGQTSWETPVYNKGGNGVSVEVQTKQKDSLLNHYREMIRVRQQHEELVKGTLQSISVDSKEVVAYSRTYKGNSISVYHNISNQPVKVSVAAKGKLIFASEKGAKKVKNQLVIPANTTVLIK

SEQ ID NO: 185 - DNA, 1572 bp, Environmental
atgaaactgatgaaagggaaaaaatggacagctttagctctaacactgccgctggctgctagcttatcaacaggcgttcacgccgaaactgtacataaaggtaaagctccaacagcagataaaaacggtgtcttttatgaggtgtatgtaaactctttttacgatgcaaataaagatggacatggtgatttaaaaggtcttacacaaaagctggactatttaaatgacggaaattctcatacaaagaatgatcttcaagtaaacgggatttggatgatgccagtcaacccttctcctagctatcataaatatgatgtaacggattattataacattgatccgcagtacggaaatctgcaagattttcgcaagctgatgaaagaagcagacaaacgagacgtaaaagtcattatggaccttgttgtgaatcatacgagcagcgaacacccttggtttcaagctgcgttaaaagataaaaacagcaagtacagagattactatatttgggctgataaaaataccgacttgaatgaaaaaggatcttggggacagcaagtatggcataaagctccaaacggagagtatttttacggaacgttttgggaaggaatgcctgacttaaattacgataaccctgaagtaagaaaagaaatgattaacgtcggaaagttttggctaaagcaaggcgttgatggcttccgcttagatgctgcgcttcatatttttaaaggtcaaacgcctgaaggcgctaagaaaaatattctgtggtggaatgagtttagagatgcgatgaaaaaagaaaaccctaacgtatatctaacgggtgaagtatgggatcagcctgaagtggtagctccttactatcaatcgcttgattccctatttaactttgatttagcagggaaaattgtcagttctgtaaaagcaggaaatgatcaaggaatcgccactgcagcagcggcaacggatgagctgttcaaatcatacaatccaaataaaattgacggcattttcttaaccaaccatgaccaaaaccgcgtcatgagtgaactgatcggcgatgtgaacaaagcaaaatcagctgcttctatcttacttacgcttcctggcaacccgtatatttattacggtgaagaaattggcatgaccggtgaaaagcctgatgagttaatccgtgaaccgttccgctggtacgaaggaaacggacttggacaaaccagctgggaaacacctgtatataacaaaggcggcaacggcgtgtctgtagaagcacaaaccaaacaaaaggattctttgttaaatcattaccgtgaaatgattcgcgtgcgtcagcagcatgaagagttagtaaaaggaacgcttcaatctattttagtagacagtaaagaagttgttgcctatagccgtacgtataaagacaactcgattagcgtgtatcataatatttcaaatcaaccggtaaaagtatctgtagcagcaaaaggtaaattaatttttgctagtgaaaaaggtgctaaaaaagtcaagaatcagcttgtgattccggctaatacaacggttttaataaaataa

SEQ ID NO: 186 - protein, 523 aa, Environmental
MKLMKGKKWTALALTLPLAASLSTGVHAETVHKGKAPTADKNGVFYEVYVNSFYDANKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVDGFRLDAALHIFKGQTPEGAKKNILWWNEFRDAMKKENPNVYLTGEVWDQPEVVAPYYQSLDSLFNFDLAGKIVSSVKAGNDQGIATAAAATDELFKSYNPNKIDGIFLTNHDQNRVMSELIGDVNKAKSAASILLTLPGNPYIYYGEEIGMTGEKPDELIREPFRWYEGNGLGQTSWETPVYNKGGNGVSVEAQTKQKDSLLNHYREMIRVRQQHEELVKGTLQSILVDSKEVVAYSRTYKDNSISVYHNISNQPVKVSVAAKGKLIFASEKGAKKVKNQLVIPANTTVLIK

SEQ ID NO: 187 - DNA, 2052 bp, Environmental
atgtatctcatccaggaggggcacatgcgttttccgcccattattcacccgcttaccggcctggccgttccggttggagctctgcgtaccgcacagagctgcggcataggggagtttgccgacttgccggttcttgccgaattctgcaaaaaagccggatttgatcttgtacagcttcttccggtcaatgacaccggcacagaaagttctccatacagcgcgctttctgcctttgccctgcacccgctgtatatcaggctttccgacctgcctgaagcagcgggtttcgaaaagcagattacagatctgaaaagccggtttgaggacttgcctcgtttcagctatacggagctgcgccgtgccaaactggatatcctgcgtgcagtgtttgataaaaacaaggcaaccatcatcggcagtgccgaactggaagcctggatttcagataacccctggatcatcgaatatgcggtttttatgaaccagaaacaccgcaactttgaagccggctggaaacattgggaaaagctgcgcaaccccactcataacgaaatacaaaaaacctggcagggtaaaacctggcaggctgaccatcaattctttgcatggctgcagatgcggctggaccagcagtttactgccgccgctacagagtgcaacgccctgggtgtctatcttaagggcgatatacctataatgatgaacgaggattccgcagatgcctgggcgaatccggaattcttccgtgacgatcttcgggccggaagtccccctgacggtgaaaacccccagggacaaaactggggcttccccatttataactgggaaaaccttgcaaatgacgggtacagctggtggaaaaaacgtctgaagcacagcgcacggtattaccatgcctaccgcattgaccatattcttgggtttttccggatatgggctataccctatggcgaatactccggctacctgggatggcccttgccgcatgaaccggtaagtgcagcagaactggcagaacggggcttttccaaggaccgcttgcgctggcttaccgaaccccacttgcctacacgggcagccgaggaagcgaataactgggactatctgggaacacacggctatctgaatcagatcatgaaccgtatcggtgaagaagaactatggctgttcaagcccgagatcacctgcgaggcagatatacgaaacacaaacctgccggatgccctgaaagaggttctggtacggcagtggaaaaaccggctgctgcaggttaccggccgcgacgaaaaaggacggacaatctactatccgctgtggcgtttccgtgacagcactgcatggcagacgcttaccgatggcgagaaacactccctggaagagctgttcgcccaaaaagcggcgcacaatgaaaccctgtggcgagaacaggcggtggaacttctgggtgagctgacgcgatctacggatatgcttgcctgtgctgaagatctgggaagtattccccacagtgtaccggaagtgctttcaaacctttcaatttacagtctgcgggttacccgctgggcccgccaatgggatgcccccggccagccctttcacagactggaggagtatccgctcatgtcggtagcgaccccatcggttcatgattcctctaccctgcgcggatggtgggaaaccgaaggcggcgaccgggcctttatggacgcatggcctccggaacaggatgcatacgcaggagcaggccgccatgagttcgaaggcgcctggggaccccgccaggcatcctgggtactccgtaaactctgcgaagcccgttccgcgctctgtgttttccccatccaggatattttggccctgtcttcagacttttatgcaatgacagcggacgaggaacgcatcaatattccgggcagtgtatccggatttaactggacataccggttgcctgcggcaatcgaggatttatctaaaaacagccaacttataaccgcaatccagaccgcgttgcaggaccgccgggcgaggaaggcacaaggagcacagcaatga

SEQ ID NO: 188 - protein, 683 aa, Environmental
MYLIQEGHMRFPPIIHPLTGLAVPVGALRTAQSCGIGEFADLPVLAEFCKKAGFDLVQLLPVNDTGTESSPYSALSAFALHPLYIRLSDLPEAAGFEKQITDLKSRFEDLPRFSYTELRRAKLDILRAVFDKNKATIIGSAELEAWISDNPWIIEYAVFMNQKHRNFEAGWKHWEKLRNPTHNEIQKTWQGKTWQADHQFFAWLQMRLDQQFTAAATECNALGVYLKGDIPIMMNEDSADAWANPEFFRDDLRAGSPPDGENPQGQNWGFPIYNWENLANDGYSWWKKRLKHSARYYHAYRIDHILGFFRIWAIPYGEYSGYLGWPLPHEPVSAAELAERGFSKDRLRWLTEPHLPTRAAEEANNWDYLGTHGYLNQIMNRIGEEELWLFKPEITCEADIRNTNLPDALKEVLVRQWKNRLLQVTGRDEKGRTIYYPLWRFRDSTAWQTLTDGEKHSLEELFAQKAAHNETLWREQAVELLGELTRSTDMLACAEDLGSIPHSVPEVLSNLSIYSLRVTRWARQWDAPGQPFHRLEEYPLMSVATPSVHDSSTLRGWWETEGGDRAFMDAWPPEQDAYAGAGRHEFEGAWGPRQASWVLRKLCEARSALCVFPIQDILALSSDFYAMTADEERINIPGSVSGFNWTYRLPAAIEDLSKNSQLITAIQTALQDRRARKAQGAQQ

SEQ ID NO: 189 - DNA, 1596 bp, Environmental
atgcaaacgattgcaaaaaaaggggatgaaacgatgaaagggaaaaaatggacagctttagctctaacactgccgctggctgctagcttatcaacaggcgttcacgccgaaaccgtacataaaggtaaatctccagctgcagataaaaacggtgtcttttatgaggtgtatgtaaactctttttacgatgcaaataaagatggacatggtgatttaaaaggtcttacacaaaaactggactatttaaatgatggcaattctcatacaaagaatgatcttcaagtaaacgggatttggatgatgccgatcaacccttctcctagctatcataaatatgatgtaacggactattataacattgattctcagtacggaaatctgcaagattttcgcaagctaatgaaagaagcagataaacgagatgtaaaagttattatggacctcgttgtgaatcatacgagcagtgaacacccttggtttcaagctgcgttaaaagataaaaacagcaagtacagagattactatatttgggctgataaaaataccgatttgaatgaaaaaggatcttggggacaacaagtatggcacaaagctccaaacggagagtatttttacggaacgttctgggaaggaatgcctgacttaaattacgataaccctgaagtaagaaaagaaatgattaacgtcggaaagttttggctaaagcaaggcgttgacggcttccgcttagatgctgcccttcatatctttaaaggtcaaacacctgaaggcgctaagaaaaatattgtgtggtggaatgaatttagagatgcgatgaaaaaagaaaacccgaacgtatatctaacgggcgaagtatgggatcagccggaagtggtagctccttattatcagtcgcttgattccctatttaactttgatttagcaggaaaaattgtcagctctgtaaaagcaggaaatgatcaaggaatcgctactgcagcagcggcaacagatgaactgttcaaatcatacaatccaaataaaattgacggcattttcttaaccaatcatgaccaaaatcgcgtcatgagtgagttaagcggagatgtcaataaagcaaagtcagctgcctctatcttacttacgcttcctggaaatccgtatatttattacggtgaagaaatcggcatgaccggtgaaaagcctgatgaattaatccgtgaaccgttccgctggtacgaaggaaacggacttggacaaactagttgggaaacacctgtatacaataaaggcggcaacggcgtgtctgtagaagcacaaaccaaacaaaaggactctttgttaaatcattaccgtgaaatgattcgcgtgcgtcagcagcacgaagagttagtaaaaggaacgcttcaatctatttcagtagacagtaaagaagttgttgcttatagccgtacgtataaaggcaactccattagtgtgtatcataatatttcaaatcaacctgtaaaagtatctgtagcagcgaaaggtaaattgatttttgctagtgaaaaaggtgctaaaaaggtcaaaaatcagcttgtgattccggcgaatacaacggttttagtaaaataa

SEQ ID NO: 190 - protein, 531 aa, Environmental
MQTIAKKGDETMKGKKWTALALTLPLAASLSTGVHAETVHKGKSPAADKNGVFYEVYVNSFYDANKDGHGDLKGLTQKLDYLNDGNSHTKNDLQVNGIWMMPINPSPSYHKYDVTDYYNIDSQYGNLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVDGFRLDAALHIFKGQTPEGAKKNIVWWNEFRDAMKKENPNVYLTGEVWDQPEVVAPYYQSLDSLFNFDLAGKIVSSVKAGNDQGIATAAAATDELFKSYNPNKIDGIFLTNHDQNRVMSELSGDVNKAKSAASILLTLPGNPYIYYGEEIGMTGEKPDELIREPFRWYEGNGLGQTSWETPVYNKGGNGVSVEAQTKQKDSLLNHYREMIRVRQQHEELVKGTLQSISVDSKEVVAYSRTYKGNSISVYHNISNQPVKVSVAAKGKLIFASEKGAKKVKNQLVIPANTTVLVK

SEQ ID NO: 191 - DNA, 1596 bp, Environmental
atgcaaacgattgcaaaaaaaggggatgaaacgatgaaagggaaaaaatggacagctttagctctaacactgccgctggctgctagcttatcaacaggcgttcacgccgaaaccgtacataaaggtaaatctccaacagcagataaaaacggtgtcttttatgaagtgtatgtaaactctttttacgatgcaaataaagatggacatggtgacttaaaaggtcttacacaaaagttggactatttaaatgacggcaattctcatacaaaaaatgatcttcaagtaaacgggatttggatgatgccagtcaacccttctcctagctatcataaatatgatgtaacggactattataacattgatccgcagtacggaaatctgcaagattttcgcaagctgatgaaagaagcagacaaacgagacgtaaaagtcattatggaccttgttgtgaatcatacgagcagtgaacacccttggtttcaagctgcgttaaaagataaaaacagcaagtacagagattactatatttgggctgataaaaataccgacttgaatgaaaaaggatcttggggacaacaagtatggcataaagctccaaacggagagtatttttacggaacgttctgggaaggaatgcctgacttaaattacgataaccctgaagtaagaaaagaaatgattaacgtcggaaagttttggctaaagcaaggcgttgacgggttccgcttagatgctgcgcttcatatttttaaaggtcaaacagctgaaggcgctaagaaaaatatcctgtggtggaatgagtttagagatgcgatgaaaaaagaaaatccgaatgtatatctaacgggtgaagtatgggatcagcctgaagtggtagctccttattatcaatcgcttgattctttatttaattttgatttagcaggaaaaattgtcagctctgtaaaagcaggaaatgatcaaggaatcgccactgcagcagcagcaacagatgaactgttcaaatcatacaatccaaacaaaattgatggcatattcttaaccaaccatgaccaaaatcgcgtcatgagtgagctgagcggcgatgtgagcaaagcaaaatcagctgcttctatcttacttacgcttcctggcaacccgtatatttattacggtgaagaaatcggcatgaccggtgaaaagcctgatgaattaatccgtgaaccgttccgctggtacgaaggaaacggacttggacaaaccagttgggaaacacctgtatacaataaaggcggaaacggtgtgtctgtagaagcacaaaccaaacaaaaggattctttgttaaatcattaccgtgaaatgattcgcgtgcgtcagcagcatgaagagttagtaaaaggaacgcttcaatctatttcagtagacagtaaagaagttgttgcttatagccgtacgtataaaggcaactccattagtgtgtatcataatatttcaaatcaaccggtaaaagtatctgtagcagcgaaaggtaaattgatttttgctagtgaaaaaggtgctaagaaagtcaaaaatcagcttgtggttccggcgaatacaacggttttaatgaaataa

SEQ ID NO: 192 - protein, 531 aa, Environmental
MQTIAKKGDETMKGKKWTALALTLPLAASLSTGVHAETVHKGKSPTADKNGVFYEVYVNSFYDANKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVDGFRLDAALHIFKGQTAEGAKKNILWWNEFRDAMKKENPNVYLTGEVWDQPEVVAPYYQSLDSLFNFDLAGKIVSSVKAGNDQGIATAAAATDELFKSYNPNKIDGIFLTNHDQNRVMSELSGDVSKAKSAASILLTLPGNPYIYYGEEIGMTGEKPDELIREPFRWYEGNGLGQTSWETPVYNKGGNGVSVEAQTKQKDSLLNHYREMIRVRQQHEELVKGTLQSISVDSKEVVAYSRTYKGNSISVYHNISNQPVKVSVAAKGKLIFASEKGAKKVKNQLVVPANTTVLMK

SEQ ID NO: 193 - DNA, 1962 bp, Environmental
atgaaattcaaaaagagtttatctgccgggctccttttgttcggaggtctgagcggtgtgacaccatccgtcgctgcggaggtgccacgaaccgcatttgtccatttattcgaatggagttggccggatattgccaccgaatgcgaaacctttcttggccctaaggggttctctgcggttcaggtgtctccgccgcaaaaaagcgtcagcaatgctgcctggtgggcgcgctaccaacctgttagttactcttttgaagggcgcagtggaacccgggctcaatttgcggatatggtccagcgttgtaaagcggtgggggtcgatatttatctggatgcggtgatcaaccatatggcagcacaagatcgctattttccagaagtaccttacagcagtaatgattttcacagttgcacgggcgatatcgattattccaaccgctggtcgattcaaaattgcgatctggttgggctgaacgatctcaaaaccgagtcagaatacgttcggcagaaaattgcagactatatgaacgatgcgctcagtctgggcgtggcggggtttcggattgatgccgccaagcatatcccggccggcgacatcgcggcgatcaagagcaagctcaacggcagcccgtatatctatcaggaggttatcggggcggcaggggagccggtacaaaccagcgagtacacgtatattggagacgtgacggaatttaacttcgcccggaccatcgggcctaaatttaagcaaggtaatattaaagacctgcaggggattggttcgtggagcggctggctgagcagcgacgatgcggtgacctttgtgaccaaccatgacgaagaacgccataaccctggccaggttctcagccatcaggactttggcaatctgtatttcctcggtaacgtgtttactctggcgtatccttacggctacccaaaagtgatgtcggggtactacttcagtaattttgatgccgggccaccatcgacaggggtacattctggtaatgcgtgtggctttgatggcggtgattgggtctgcgaacacaaatggcgtggtgtagccaacatggtggcgtttcgcaaccacacagcagcccagtggcaggtcactgactggtgggacgatggttacaatcaggtggcgtttggtcgtggcgggctgggctttgtggtgatcaatcgagatgacaataaaggcatcaatcagagtttccagacgggaatgcccgctggcgagtattgtgacatcattgccggtgatttcgacacccagagcggtcattgcagcgctacgacgatcaccgtcgacagtcaggggtatgcacattttactgtcggtagtcatcaggccgctgcgattcacattggcgcgaaactcggctccgtgtgccaggactgtggcggcacggccgcagagacaaaagtctgctttgacaatgcacaaaactttagccaaccgtatttgcattactggaatgtcaatgcggatcaggccgtagcgaatgcaacctggccgggcgtcgcgatgacggctgaaaatggcggttactgctacgattttggtgtcggtctcaattcacttcaggtaattttcagcgataacggcgccagccaaaccgctgatctgaccgccagcagtccgacgttgtgttaccagaacggaacgtggcgtgacagtgacttctgtcagagtagcaatgtgggcaacgagagttggtatttccgtggaacctcaaacggttggggcgtgagcgcactcacttatgaggctgcgacaggcctgtacactacggtgcagagctttaacggggaggagtcgcccgcacgctttaaaattgatgatggcaactggagtgagtcgtatccaagtgctgattatcaagtcggtgattatgccacctacacgatcacgtttgacagccagacgaaggccatcaccgtgacttcgcagtaa

SEQ ID NO: 194 - protein, 653 aa, Environmental
MKFKKSLSAGLLLFGGLSGVTPSVAAEVPRTAFVHLFEWSWPDIATECETFLGPKGFSAVQVSPPQKSVSNAAWWARYQPVSYSFEGRSGTRAQFADMVQRCKAVGVDIYLDAVINHMAAQDRYFPEVPYSSNDFHSCTGDIDYSNRWSIQNCDLVGLNDLKTESEYVRQKIADYMNDALSLGVAGFRIDAAKHIPAGDIAAIKSKLNGSPYIYQEVIGAAGEPVQTSEYTYIGDVTEFNFARTIGPKFKQGNIKDLQGIGSWSGWLSSDDAVTFVTNHDEERHNPGQVLSHQDFGNLYFLGNVFTLAYPYGYPKVMSGYYFSNFDAGPPSTGVHSGNACGFDGGDWVCEHKWRGVANMVAFRNHTAAQWQVTDWWDDGYNQVAFGRGGLGFVVINRDDNKGINQSFQTGMPAGEYCDIIAGDFDTQSGHCSATTITVDSQGYAHFTVGSHQAAAIHIGAKLGSVCQDCGGTAAETKVCFDNAQNFSQPYLHYWNVNADQAVANATWPGVAMTAENGGYCYDFGVGLNSLQVIFSDNGASQTADLTASSPTLCYQNGTWRDSDFCQSSNVGNESWYFRGTSNGWGVSALTYEAATGLYTTVQSFNGEESPARFKIDDGNWSESYPSADYQVGDYATYTITFDSQTKAITVTSQ

SEQ ID NO: 195 - DNA, 2790 bp, Environmental
atgctgacagaccgtttctttgatggcgatacatcaaacaacgacccttacaaccagaactacgatgctaaaaacgaccggggaacttatcagggcggcgattttaaaggaatcacgcaaaaattggattatctcgataagctaggcgtgaacacaatctggatcagcccgatcgtggaaaatatcaagcatgatgtccgttatgacaactctgaagggcattcatactatgcttaccacggctactgggcaagcaacttcggtgcgttaaacccacacttcggtacaatggaagatttccatacactgattgacgctgcccatgaaaaaggcatcaagatcatggttgacgtagtattaaaccacactggttatggcttaaaagatatcaacggagaagtttccaatcctccagccggttacccaactgacgcagaacgcagcacatatagcagcctgcttcgccagggttcaaatgtcggctctgatgaggttgttggcgaattagctggcctacctgacttaaaaacagaagaccccgcagtccgccagacaatcatcgactggcaaacagactggatcacgaaagctactacagctaaaggaaacacaattgactacttccgtgtcgacactgtgaagcacgttgaagacgcaacatggatggcattcaaaaatgacctcactgaaaaaatgccgacacacaaaatgatcggggaagcttggggagcaagtgccaataaccaacttggataccttgaaacaggtatgatggactcactgcttgacttcgacttcaaaggcattgcgcacgatttcgtgaacggcaagcttaaggcagcaaacgatgccctgactgcccgcaacggtaaaattgacaacacagctactttaggttcattccttggaagccatgacgaagatggtttcctatttaaagaaggaaatgacaaaggcaagcttaaggttgctgcttccctgcaagcaacatcaaaaggccagccggtcatctattatggtgaagagcttggtcaaagtggagcaaacaactatccgcaatacgataaccgttatgacctggcatgggacaaagttgaaaacaacgacgtccttgagcactacactaaggtcctgaacttcagaagcgctcattcagaagtgttcgctaaaggtgaacgcgcaacaattggcggttctgacgctgataaattcttactttttgctcgtaaaaatggaaacgaagctgcttacgtcggcttgaacgttgctgacacagcaaaagacgtaacactgactgtttctgcaggtgcagtcgtaactgaccactatgcagataaaacttatactgcttcagaagctggagaaatcacattgacgatcccggcaaaagctgatggcggtactgttttactaacggttgaaggcggagaaatcacagctgctaaagcggcaagcgaaggcgacggcacagttgagccagtccctgcgaaccacatccgcattcactacaaccgtacagacaacaactatgaaaactacggtgcatggctgtggaacgatgtagcctccccttctgccaactggccgactggcgctacaatgtttgaaaaaacagacagctacggtgcatacatcgacgtaccacttaaagagggcgctaagaacatcggcttcctcgttatggatgtaacaaaaggtgatcagggtaaagacggcggcgacaaaggttttacgatctcatcacctgaaatgaacgaaatttggatcaagcaaggttctgacaaggtgtacacttacgagccagttgatcttccggcgaacactgtccgcgtccactatgtacgtgacaacgcagactacgaaaacttcggtatctggaactggggcgatgtaacagcaccttccgaaaactggcctacaggcgcagcgaaattcgatggtacagaccgttacggtgcgtatgtcgacattacgctaaaagaaggcgcaaagaacattggaatgattgctcttaacactgcaaatggagagaaagacggcggagataaatccttcaaccttctggataaatataatcgcatttggattaaacaaggtgatgacaatgtctacgtttctccatactgggagcaggcaacaggaatcaccaatgcagaggtaatctctgaagatacgattctattaggcttcacaatgactgacggcttaacacctgaatctttaaaaggaggtcttgtaattaaagattcaactggtgctgaagttgccatcgaaagtgctgaaatcacaagcgcaacctctgtaaaagtaaaagcaacattcgatttagaaaagcttccattatccatcacatacgcaggcagaacagtttcagcttcaactggctggagaatgcttgatgaaatgtacgcttatgatggaaacgaccttggtgcgacttacaaggacggagcagcgacgcttaaattatgggctccgaaagcgagcaaggtaaccgctaacttctttgataaaaataatgccgctgaaaaaatcggcagcgtcgagttaacgaagggtgaaaaaggagtctggtcagctatggttgctcctggcgacctgaacgtaaccgatcttgaaggttatttttaccagtatgatgtaacaaatgacggtataactcgccaggtgttagatccttatgcaaaatcaatggcagcctttactgtgaatacagaaggcaatgctggtcctgacggggacactgttggcaaggcggcaattcaaaaagcttctcgagagtacttctag

SEQ ID NO: 196 - protein, 929 aa, Environmental
MLTDRFFDGDTSNNDPYNQNYDAKNDRGTYQGGDFKGITQKLDYLDKLGVNTIWISPIVENIKHDVRYDNSEGHSYYAYHGYWASNFGALNPHFGTMEDFHTLIDAAHEKGIKIMVDVVLNHTGYGLKDINGEVSNPPAGYPTDAERSTYSSLLRQGSNVGSDEVVGELAGLPDLKTEDPAVRQTIIDWQTDWITKATTAKGNTIDYFRVDTVKHVEDATWMAFKNDLTEKMPTHKMIGEAWGASANNQLGYLETGMMDSLLDFDFKGIAHDFVNGKLKAANDALTARNGKIDNTATLGSFLGSHDEDGFLFKEGNDKGKLKVAASLQATSKGQPVIYYGEELGQSGANNYPQYDNRYDLAWDKVENNDVLEHYTKVLNFRSAHSEVFAKGERATIGGSDADKFLLFARKNGNEAAYVGLNVADTAKDVTLTVSAGAVVTDHYADKTYTASEAGEITLTIPAKADGGTVLLTVEGGEITAAKAASEGDGTVEPVPANHIRIHYNRTDNNYENYGAWLWNDVASPSANWPTGATMFEKTDSYGAYIDVPLKEGAKNIGFLVMDVTKGDQGKDGGDKGFTISSPEMNEIWIKQGSDKVYTYEPVDLPANTVRVHYVRDNADYENFGIWNWGDVTAPSENWPTGAAKFDGTDRYGAYVDITLKEGAKNIGMIALNTANGEKDGGDKSFNLLDKYNRIWIKQGDDNVYVSPYWEQATGITNAEVISEDTILLGFTMTDGLTPESLKGGLVIKDSTGAEVAIESAEITSATSVKVKATFDLEKLPLSITYAGRTVSASTGWRMLDEMYAYDGNDLGATYKDGAATLKLWAPKASKVTANFFDKNNAAEKIGSVELTKGEKGVWSAMVAPGDLNVTDLEGYFYQYDVTNDGITRQVLDPYAKSMAAFTVNTEGNAGPDGDTVGKAAIQKASREYF

SEQ ID NO: 197 - DNA, 1401 bp, Environmental
atgaaaccgtcaaaattcgtttttctctctgctgccatcgcttgcagcctctccagtaccgccaatgctgacgccattttgcatgcatttaactggaagtactccgacgtcacgcaaaacgcctcgcaaatcgcggcggcgggttataaaaaagtgctgatttcgccagcactgaaatcgagtggcaatgaatggtgggcacgttatcaaccgcaagatctgcgcgtgatcgattccccacttggcaacaaaagtgacttaaaatccatgattgatgctctgaaggcggtcggcgttgatgtgtatgccgatgtggtgcttaaccatatggccaatgaaacatggaagcgtgaagacttaaattaccctggcagtgaagtgctgcaacaatacgcagctaacaccagttattatgcggaccaaacgctttttggcaatttaacggaaaacctattctctggctttgacttccacccagaaggctgtattagcgattggaatgatgccggcaatgttcagtactggcgtctttgtggcggtgctggtgaccgagggctgccagacttagatccgaacaactgggtggtgtcacagcaacgtttgtatttgaatgcgctaaaaggtttaggtgtgaaaggcttccgcattgatgcggttaaacacatgagccaatatcaaatcgaccagattttcactgcagagattaccgccggaatgcacgtgtttggtgaagtgatcaccagtggtggcaaaggcgactccagctatgagaacttcttagcgccttatctcaacgccaccaaccattcggcttacgatttcccactgtttgcctctattcgcaacgccttctcctacagcggtggcatgaacatgcttcatgatccacaagcctatggccaagggcttgaaaacgcacgttcaattacctttaccatcacgcacgacatcccaacgaacgacggtttccgttatcaaatcatggatccgaaagatgaagagctggcttacgcttatatcctcggtaaagatggcggcacacctctgatttacagcgacaacttacctgataacgaagatcgtgataatcgccgttgggaaggtgtttggaaccgtgacctgatgaagaacatgttgcgcttccataaccaaatgcaagggcaagagatgacgatgctgtacagcgaccaatgtctactgatgtttaagcgcggtaaacaaggggtggtcggcattaataaatgcggtgaagagcgttctcataccgttgacacctatcagcatgagttcaactggtatcagccttacacagatacactcactggcgtgactgaaaccgtgagttcgcgttaccacaccttccgaattccagctcgcagcgcgcgcatgtacatgctctaa

SEQ ID NO: 198 - protein, 466 aa, Environmental
MKPSKFVFLSAAIACSLSSTANADAILHAFNWKYSDVTQNASQIAAAGYKKVLISPALKSSGNEWWARYQPQDLRVIDSPLGNKSDLKSMIDALKAVGVDVYADVVLNHMANETWKREDLNYPGSEVLQQYAANTSYYADQTLFGNLTENLFSGFDFHPEGCISDWNDAGNVQYWRLCGGAGDRGLPDLDPNNWVVSQQRLYLNALKGLGVKGFRIDAVKHMSQYQIDQIFTAEITAGMHVFGEVITSGGKGDSSYENFLAPYLNATNHSAYDFPLFASIRNAFSYSGGMNMLHDPQAYGQGLENARSITFTITHDIPTNDGFRYQIMDPKDEELAYAYILGKDGGTPLIYSDNLPDNEDRDNRRWEGVWNRDLMKNMLRFHNQMQGQEMTMLYSDQCLLMFKRGKQGVVGINKCGEERSHTVDTYQHEFNWYQPYTDTLTGVTETVSSRYHTFRIPARSARMYML

SEQ ID NO: 199 - DNA, 399 bp, Environmental
gtgagtttgaccaaaaaggctcagtacgaaccaaatacggcaccaaggctcagtacatctctgcaatcaatgccgcgcacaacaacaatatccaaatttacggcgatgttgtgtttaaccaccgaggtggtgctgatgggaagtcgtgggtcgataccaagcgcgttgattgggacaaccgcaatattgaactgggcgacaaatggattgaagcttgggttgagtttaattttcctggccgcaacgacaaatactcgaacttccattggacttggtatcactttgacggtgttgactgggatgacgccggcaaagaaaaagcgatctttaaattcaaaggcgaaggaaaagcatgggattgggaagtcagctctgaaaaaggcaattacgactacctaa

SEQ ID NO: 200 - protein, 132 aa, Environmental
VSLTKKAQYEPNTAPRLSTSLQSMPRTTTISKFTAMLCLTTEVVLMGSRGSIPSALIGTTAILNWATNGLKLGLSLIFLAATTNTRTSIGLGITLTVLTGMTPAKKKRSLNSKAKEKHGIGKSALKKAITTT

SEQ ID NO: 201 - DNA, 1911 bp, Environmental
atgacagccaaggctgatgacttacgcatttaccagatcatggtggaaagctttgtggatggcgataaacaggtcggccatggcaccggctacggtaccagccatcacaaaggcgatctgcaagggatcattgactcgctggattacattcaatcgctgggcgtcaatgccatttggctaacgccgatttttgaatctattccggtggagggacaagaccattgggcggacaggcttgatgctacaggctactttgccagtgactatttcaagatagaccctcgctttggcacgttagaacaagcccgtgagctggtggaaaaggcacacgcgaaaggcttgtatgtcttctttgatggagtatttggtcaccataaaggcaatgtggtgccatcaccacaaggtagactgcctgtcggtgaaaataacccggtcagctacccagagagcctggcgttttacgaagaagtcgccagttactgggtgaaagagttaaagattgatggctggcgtctggatcaagcctatcaagtgccgaccgatgcatggaaagcgatccgtcagagcgttgatgaagcgtcacagtccgtaacttatgtgaataacaaaggggaaaccgtccatcctttgggttacatggtggctgaaatttggaataacgaacgttacatcacagaaaccggttacggcaaagaaggcgatccggcgttgtgctcggcttttgattttccgatgcgtttccgagtggtcgaaacctttgcggttaacgaaagtggtgtcagccgaaaaggcggcgaatggttgaatgacggcatgtcactgcacagtcagtatccggatcatgccaagcctaatttaatgttgggcaaccatgatgtggtgcgctttggggatctgctgcaacgtggcggtattgcgtcaccagaacaaccgcaatactggcagcgtcataaagcggcgatgtctttcttagcagcgtataccggcccaattaccttgtattacggtgaagaaattggcgatcaggttgacggctttgctaaaaaaatcaaagaagattgtgccgttattggtttgtgtgatgaccacgtggcgcgcaccagtgcgaagattgatggcgtgacggcgtcactgaatgcacagcagtctgaactcaaagtatatgtctcttcattgatgacattacgtcagcaacatcctgcgttatcacaaggggaacgtactaatgtgatggcgacagagacagtatacgtagaccataaacaggcagacaatgaagccctgttgtacatggtgagtacgactgataacgcggagtcagtcaccttgaagggcaaagcgattggttcacaaggtgtgctgattgatttgttaacgaacgagcgttttatgcccaataatggggagtatgccattccattaacgggctttggcgcacgattcctcaagattgacactccgacagcggcgggtgtgatggcgcaatctgctgcctcggtatcgctagtaggtgaagggatcatggcccaatgtgataccccaaccgttgaaggcaccggtccggtagcagaaaccttgtacgtggttggcgattttgccgatgctggttggaagcaaaagccgcagcgcgcgtatcaatacaaaggcaagcacaatggcagcaacttgtatcaagtggttgtcgatgaaaaagcgggcgcctacaagatgcaatacgccacgaaagattggagcccacagtttactgcagacggtatggcattgaagccgggtaccgcaaagtcgctcatagcgggtggctacggtaaagacaccgccgtgacgttgccggaatccggtaagtatgtgtggagcttaacattcagtgatcttggcgagccggagcaaatcatggtgtctaagtgtcagtaa

SEQ ID NO: 202 - protein, 630 aa, Environmental
MTAKADDLRIYQIMVESFVDGDKQVGHGTGYGTSHHKGDLQGIIDSLDYIQSLGVNAIWLTPIFESIPVEGQDHWADRLDATGYFASDYFKIDPRFGTLEQARELVEKAHAKGLYVFFDGVFGHHKGNVVPSPQGRLPVGENNPVSYPESLAFYEEVASYWVKELKIDGWRLDQAYQVPTDAWKAIRQSVDEASQSVTYVNNKGETVHPLGYMVAEIWNNERYITETGYGKEGDPALCSAFDFPMRFRVVETFAVNESGVSRKGGEWLNDGMSLHSQYPDHAKPNLMLGNHDVVRFGDLLQRGGIASPEQPQYWQRHKAAMSFLAAYTGPITLYYGEEIGDQVDGFAKKIKEDCAVIGLCDDHVARTSAKIDGVTASLNAQQSELKVYVSSLMTLRQQHPALSQGERTNVMATETVYVDHKQADNEALLYMVSTTDNAESVTLKGKAIGSQGVLIDLLTNERFMPNNGEYAIPLTGFGARFLKIDTPTAAGVMAQSAASVSLVGEGIMAQCDTPTVEGTGPVAETLYVVGDFADAGWKQKPQRAYQYKGKHNGSNLYQVVVDEKAGAYKMQYATKDWSPQFTADGMALKPGTAKSLIAGGYGKDTAVTLPESGKYVWSLTFSDLGEPEQI

SEQ ID NO: 203 - DNA, 2601 bp, Environmental
atgaagatgaagtcccgggcgtggttgttaggtagtgcagtggccatggcgttggcctcttcggcagccaatgccggtgtcatggttcacctgttccagtggaagtacaatgacatcgccaacgagtgcgaaaaggtgctcggtcccaaagggtatgaagcagtgcagatcacgccgcctgctgaacacctgcaaggctcctcctggtgggtggtctatcagcccgtcagctacaagaacttcacttctctgggcggtaacgaggccgaactcaaaagcatgatcgcccgttgcaaggccgccggggtcaagatttacgccgatgcggtattcaaccagctggctggtggatcaggcgtcggtacaggtggtagcagctacaatgccggcagcttcagctatccccaatttggctacaacgatttccatcacgctgggagcctcaccaactatgccgaccgcaacaatgtgcaaaacggtgccctgctggggctgccggatctggataccggctctgcctatgtgcaggatcagctggctacctatatgaagaccctgagtggctggggtgtggcaggttttcgtcttgatgcagcaaagcatatgagcgttgccgatctctcggccatcgtcagcaaggcgggcaatccttttgtctactccgaggtgattggtgccacgggtgaaccaatccagccgggcgaatataccggcattggtgccgtgaccgaatttaaatacggcaccgatctggcctccaacttcaaggggcagatcaagaatctcaagagcatgggcgagagctggggtctgcttgcgtcgaacaaggctgaagtctttgtggtcaaccatgaccgtgagcggggacatggcggtggcggtatgctgacctacaaggatggtgccctctacaatctggccaacatcttcatgctggcctggccctatggcgcctatccccaggtgatgtccggctatgatttcggcaccaataccgatattggtgggccgagcgctaccccttgttcttccggctctagctggaactgcgaacaccgctggagcaacatcgccaacatggtctcgttccacaatgccgcccaaggcacgtccatgaccaactggtgggataatggtaataaccagatcgcctttggtcgcggcgccaaggcctttgtggtgatcaacaatgaatcttccactctgagcaagagcctgcagacgggtctgccagccggggagtactgcaacattctggccggtgatgccctgtgcagcggcagcaccatcaaggtggatgccagcggtatggccaccttcaacgtggcagggatgaaggcggcagcgatccatatcaatgccaagcccgatagcaccagcagtggcagctcaggctcttcctctggctcttcttcctctgccaccagtaacaagtttgccagcatgaatctgcggggcaccaacaatggctgggccagcaccgccatgacagtggatgccaaccgtgtctggtcggcggatgtcacctttaccggggccgcggatgccaatggtgcccagcgcttcaagtttgatgtctatggcaactggacagagagctatggcgatacacaagccgatggcattgccgacaaggggagcgccaaggacatctatttcaatggtgtgggcaagtatcgtgtctcgctcaaggagagcgacatgagctacaccctgacccagctctccagcaatcaggcaccggtggcggccatcacccccaagacactctccgtcaagctgggtgactcagtggtgttcgatgcctccggctccaccgatgatgtgggtgtcactggctacagctggtctaccggtggcagtgccaagaccgaaactgtgctgtttgatgctctgggtaccaagaccattaccgtgacagtggccgatgccgatggcttgacctccaaggccagtgccaccgtcaccgtcaccgatggcagcgtggcttataacagcaactttgccagcctgaacttccgtggcactcccaacagttggggcgcggcagccatgacgctggtggcagacaacacctgggaggcaacggtcaacttcgatggtcaggccaatcagcgcttcaagttcgatatcaagggtgactggagccagaactatggtgatagcaacaaggatggggtggccgaacgtaccggtgccgatatttacaccactgtgaccggtcaatataaggtgcaatttaacgactccactttgaagtacaccctgaccaagctggccgatagcagcgccaccagctatagcgcgaactttgccagcctctacctgcgtggcaccccgaacagctggggcaccaccgccatgaagctggtggccaataacagctggcaggccgaggtgaccttcaccggcaagggcgatgccactggtgcccaacgcttcaagttcgacgtcaagggtgactggagccagaactacggtgacagcaacatggacgggactgccgaacggactggtggcgatatcaccagtgccgtggtgggcacctatctggtgacctttaatgacagcacactgaaatacaccctgaccgccaaataa

SEQ ID NO: 204 - protein, 866 aa, Environmental
MKMKSRAWLLGSAVAMALASSAANAGVMVHLFQWKYNDIANECEKVLGPKGYEAVQITPPAEHLQGSSWWVVYQPVSYKNFTSLGGNEAELKSMIARCKAAGVKIYADAVFNQLAGGSGVGTGGSSYNAGSFSYPQFGYNDFHHAGSLTNYADRNNVQNGALLGLPDLDTGSAYVQDQLATYMKTLSGWGVAGFRLDAAKHMSVADLSAIVSKAGNPFVYSEVIGATGEPIQPGEYTGIGAVTEFKYGTDLASNFKGQIKNLKSMGESWGLLASNKAEVFVVNHDRERGHGGGGMLTYKDGALYNLANIFMLAWPYGAYPQVMSGYDFGTNTDIGGPSATPCSSGSSWNCEHRWSNIANMVSFHNAAQGTSMTNWWDNGNNQIAFGRGAKAFVVINNESSTLSKSLQTGLPAGEYCNILAGDALCSGSTIKVDASGMATFNVAGMKAAAIHINAKPDSTSSGSSGSSSGSSSSATSNKFASMNLRGTNNGWASTAMTVDANRVWSADVTFTGAADANGAQRFKFDVYGNWTESYGDTQADGIADKGSAKDIYFNGVGKYRVSLKESDMSYTLTQLSSNQAPVAAITPKTLSVKLGDSVVFDASGSTDDVGVTGYSWSTGGSAKTETVLFDALGTKTITVTVADADGLTSKASATVTVTDGSVAYNSNFASLNFRGTPNSWGAAAMTLVADNTWEATVNFDGQANQRFKFDIKGDWSQNYGDSNKDGVAERTGADIYTTVTGQYKVQFNDSTLKYTLTKLADSSATSYSANFASLYLRGTPNSWGTTAMKLVANNSWQAEVTFTGKGDATGAQRFKFDVKGDWSQNYGDSNMDGTAERTGGDITSAVVGTYLVTFNDSTLKYTLTAK

SEQ ID NO: 205 - DNA, 1674 bp, Environmental
atgtaccgcgtaatacctattattttgattatgagtatgattgtagcttgtgagtctccaaagaaaaaaacaaccgaaaccgctcaaccttcaacaaatgccgaaaaaccctttgtttgggaggctgccaatgtatattttttgttaactgaccgttttaacaacggtaacccaaacaatgacatcaattttaataggactaaagaatcaggaaaactccgcaattttatgggaggcgatatcaagggcatcacccaaaaaataaatgaggggtattttagtaaactaggcgttaatgccatctggcttaccccggttgttgaacaaatacatggcagtgttgatgaaggtaccggcaatacctatgcctttcatggctattgggccaaagattggacaaacttagacccaaattttggcacaaaagaagaccttgccgaactggtggcaactgcccatgcaaaaggcatcaggatacttttagatgtggtaataaaccacaccggcccggtaaccgaccaagacccggtttggggagaagattgggtacgtacaggcccgcagtgtacctatgataattacaccaataccaccagttgcacgctggtagccaatttacctgatatacttacagaaagtaatgaaaatgtggccttaccaacctttttgttagataaatggaaagccgaaggcagattagagcaagaactaaaagaacttgacgattttttttcccgcacaggccacccacgcgcaccccgcttttacattattaaatggcttaccgattacatccgagaatttggggtagatgggtttagggttgataccgtaaaacataccgaagaaacggtttgggccgagttgtatgatgaagccgtaattgcttttgccgaatataaaaaagccaacccagacaaggtattggacgataatgaattttatatggtaggcgaagtgtacaactacggtatttccggcggaaggttctatgatttcggcgataaaaaggtggactattttgaccacggatttaaaagcctcatcaattttgaaatgaaatatgatgccaattttacctacgatacactttttaggaagtacgatacccttttgcataccaaacttaaaggcagaagtgtgctcaactacctctcatctcacgacgatggaagtccatttgataaaatgcggcaaaaaccatacgagtcggctacaaaattactgctcactccgggcgcatcccaaatttattacggtgacgaaaccgccagaagccttaacatagaaggcgcacagggagatgctacgcttcgttcgtttatgaattgggaagagctcgcagaagaccctgccaagcaaaaaatacttcagcattggcaaaaactgggcagtttcaggaacaaccaccccgcagttggtgccggaaggcacaaaacccttggcaaaaagccgttttacacctttagcagggtttatcaaaaaaatggttttattgacaaagttgtggtagcattagatgcccctaaaggccaaaaacaaattaccgttaatggtgtttttgatgacggtacaaaacttgtagatgcctattcaggcaaagaaacctcagttaaaaatggtatcgtttcactttcttctgaatttgatattgttttgttagaacaaaaataa

SEQ ID NO: 206 - protein, 557 aa, Environmental
MYRVIPIILIMSMIVACESPKKKTTETAQPSTNAEKPFVWEAANVYFLLTDRFNNGNPNNDINFNRTKESGKLRNFMGGDIKGITQKINEGYFSKLGVNAIWLTPVVEQIHGSVDEGTGNTYAFHGYWAKDWTNLDPNFGTKEDLAELVATAHAKGIRILLDVVINHTGPVTDQDPVWGEDWVRTGPQCTYDNYTNTTSCTLVANLPDILTESNENVALPTFLLDKWKAEGRLEQELKELDDFFSRTGHPRAPRFYIIKWLTDYIREFGVDGFRVDTVKHTEETVWAELYDEAVIAFAEYKKANPDKVLDDNEFYMVGEVYNYGISGGRFYDFGDKKVDYFDHGFKSLINFEMKYDANFTYDTLFRKYDTLLHTKLKGRSVLNYLSSHDDGSPFDKMRQKPYESATKLLLTPGASQIYYGDETARSLNIEGAQGDATLRSFMNWEELAEDPAKQKILQHWQKLGSFRNNHPAVGAGRHKTLGKKPFYTFSRVYQKNGFIDKVVVALDAPKGQKQITVNGVFDDGTKLVDAYSGKETSVKNGIVSLSSEFDIVLLEQK

SEQ ID NO: 207 - DNA, 1378 bp, Environmental
ctgtcgactgagcctttcgttttgggctcgagactgactctcagcccaccccgcagtagctccagacggagtagccgtaatagccgttggccgggtcgtgggcaggggcctcgaggtacacccacccgcttgagtccacccacttgtccacccagccgccgaggttgccggtgtactcgtggatgcacgctcccgcgaacttcggaacgtagacccaccttccggctttgcttgaggcgaggttgatgtatgttatcagtcccggcttgcttccgtagccgtttctcacgaatatcagctcgtcgttgtcgtagtaaacgacgtcagtgcttcctccggccaggttgtcatgtatccagatgaggttcttgagcttatccttgttgagccactcctcgtagtcgcggtagaatattgtcggctggccctcgtaggtgaggatgaacgcgtaggctggatacttgttccagattatatcggtgtcgtggtttgcaacgaaggttacggccttaaacgggtcgcggctgacgactgtgcccccgttcttgagggcctcgacgagtgcgggaatgttcttgttgtcaaaggccgcgtccatcttgtagtagagcgggaagtcgaagaccttggcgccgctcgagtaggcccagttgaggagtgcatcaacgttggtgtcccagtactcgccaacggcccagccgccccaccagttgagccagtccttgacgacccacgctccgtggcccttcacgtagtcaaagcgccaggcatcaacgccgatgctccttaggtaggcggcgtagctctcatcgctcgcccagagccagtgctggtcccagctcttctcgtgggctatgtctgggaagcctccaaatgtgccctcgtcacagcacttgacctcgttggggtggaagtcgaggtagttggcagtatatttgcccgaggccacctttgagaagtccgtccaggtgtagtccccaacgaacgggttccactcgaggtctccgcctgcgcggtggtttatgacgatgtccgctatgacctttatgccgtaggcatgggccgtgtttatcatgttcacgagctcctgcttggagccaaagcgcgtctctaccgttcccttctggtcgtactcaccgaggtcaaagaagtcgtaggggtcgtagcccatcgaataggcgccgcccatgcccttgctcgccgggggaatccaaatggcggatattcccgcctcgtaccactccggtatcttgctcctgatggtgtcccaccagattcctccacctgggacgtcccagtagaaggcctgcattataacgccgccctcttccagctcggagtacttggccataagttacctcctactagtagattaaaa

SEQ ID NO: 208 - protein, 439 aa, Environmental
LSTEPFVLGSRLTLSPPRSSSRRSSRNSRWPGRGQGPRGTPTRLSPPTCPPSRRGCRCTRGCTLPRTSERRPTFRLCLRRGCMLSVPACFRSRFSRISARRCRSKRRQCFLRPGCHVSRGSAYPCATPRSRGRILSAGPRRGTRRLDTCSRLYRCRGLQRRLRPTGRGRLCPRSGPRRVRECSCCQRPRPSCSRAGSRRPWRRSSRPSGVHQRWCPSTRQRPSRPTSASPRPTLRGPSRSQSARHQRRCSLGRRRSSHRSPRASAGPSSSRGLCLGSLQMCPRHSTPRWGGSRGSWQYICPRPPLRSPSRCSPQRTGSTRGLRLRGGLRCPLPLCRRHGPCLSCSRAPAWSQSASLPFPSGRTHRGQRSRRGRSPSNRRRPCPCSPGESKWRIFPPRTTPVSCSWCPTRFLHLGRPSRRPALRRPLPARSTWPVTSYIK

SEQ ID NO: 209 - DNA, 1416 bp, Environmental
atgattcagcccatgcactctcgggaacaggcctgccgtctcattccggcactgatcatgacatttgcactggcactgccgttgcaaattcgtgccgatgtcaccctgcatgctttcaactggagctatgccgatgtcgctgatcgggccgttgacatcgctgcagcagggtacagtgccgtgctggtggccccgccacttcgatccgaaggcacggcctggtgggcgcgataccagccccaggatctccgccttatcgaccatccgctgggcaatacacatgacttcgtcaacatgatcgatgctctcgatgatgtgggtgtgggcgtgtacgccgacatcgtgctcaaccacatggccaatgaggctgcacaaaggcctgacctgaactaccctggtcaggcagtgcttgacgaatatgcttccgatcccggtcatttcgagggcttgaggctgttcggtaatctgagcttcaatttcctgtcggaacatgatttcggacccgcccagtgcattcaggattacagcgatgtgtttcaggtccagaactggcggctgtgcggaccgccgccggacccgggcctgcccgacctggtcgccaatgactgggtgatctctcaacagcgccagtatctggaagccatcaaggcgctgggtgtggctggcatgcgcatcgacgcggtcaagcatatgcccatgagccatatcaatgccgttctcacccccgagatccggtcgggcttgcatgtgtttggcgaagtcatcacctccggtggggctggtgatacatcctacgaccgttttctggccccttacctggcacaaagcgaccatggtgcctatgactttccattgtttgaaaccattcgccgtgctttcggcttcggtggcagcatgagtgaactggtcgatcctgctgcctacggtcaggccctgccaccggaccgcgccatcaccttcgtcatcacgcacgatattccgaacaatgacggatttcgctaccagatactcgaccccgtcgatgaatcactggcctacgcctacattctgggccgcgatggcggtgtcccgcttctgtattccgacaacaatgaaagcggcgatggccgctggatcgatgcctggcaacgtccggatctggttgcaatggtcggcttccacaatgcagtccacggtcaggacatggccgtgctttcacatgacgactgccacctgctgtttcggcgcggcagcctcgggattgtcggcatcaacaagtgcggccatgcactcagctcctgggtcaacatgaaccagagcgtactgtggtggtacgcggactacacagacgtgctcgacagcaacagcgttgtcaacatccagtcatcctggcacgagttcatccttcccgcccgccaggcacgcctgtggttgcga

SEQ ID NO: 210 - protein, 472 aa, Environmental
MIQPMHSREQACRLIPALIMTFALALPLQIRADVTLHAFNWSYADVADRAVDIAAAGYSAVLVAPPLRSEGTAWWARYQPQDLRLIDHPLGNTHDFVNMIDALDDVGVGVYADIVLNHMANEAAQRPDLNYPGQAVLDEYASDPGHFEGLRLFGNLSFNFLSEHDFGPAQCIQDYSDVFQVQNWRLCGPPPDPGLPDLVANDWVISQQRQYLEAIKALGVAGMRIDAVKHMPMSHINAVLTPEIRSGLHVFGEVITSGGAGDTSYDRFLAPYLAQSDHGAYDFPLFETIRRAFGFGGSMSELVDPAAYGQALPPDRAITFVITHDIPNNDGFRYQILDPVDESLAYAYILGRDGGVPLLYSDNNESGDGRWIDAWQRPDLVAMVGFHNAVHGQDMAVLSHDDCHLLFRRGSLGIVGINKCGHALSSWVNMNQSVLWWYADYTDVLDSNSVVNIQSSWHEFILPARQARLWLR

SEQ ID NO: 211 - DNA, 1491 bp, Environmental
gtgtttcgttctgacacagtttcgcgtacctgcatgtatggtgcgctgcgtaatgcctaccaacccgatcgggtgtttactggagtcacggtgcggacatgcaacttaaaaaagcatgctcatcgccaggcgctgttgttcatcgtgacgcggtgcctgtgcctgaaatccaggcagacccataaaaacaacaacaaaccgataacaaacgacccaagccttctaagaggagaaaacgggatggcttttaaactacgcaaaaaggcgctcgttggcctgttcacggccggcgcaatggtatatgccggtgcagcggcgagtggtgaaatcattctgcagggcttccactggcactccaagtggggcggcaacaatcagggttggtggcaggtgatggaaggtcaggccaacaccatcgccaacgccggctttacgcacgtgtggttcccgccggtccataactcggccgatgccgagggttacctaccccgcgagctgaacaacctcaactccagctatggctccgaagcacagctgcgcagcgccatccaggcactgaacaatcgcggcgtgcatgcgattgccgatgtggtcatgaaccaccgggtgggctgctctggctgggcggatttctgtaacccggactggccgacctggtacatcgtcgccaatgattcctggcccggtggcccgaaaagccagaactgggacacgggtgagacgtaccacgccgcccgtgacctcgatcacgccaatccgcaggtgcgcaacgatatctcgcactacctgaacagccgcctcaaggacgtcggcttctccggctggcgctgggactatgccaagggtttctggcccggctatgtcggcgagtacaactggaacaccaacccgaacttctgtgtgggtgaggtgtgggacgatctcgaccccaacaatcccaacccgcaccgccagcaactggtggactgggttgatgctaccggtggcagttgtcacgtcttcgacttcaccaccaaggggctgacgaactatgcgctgcagcatggccagtactggcgcctgcagggtgataatggtggcccggctggcggcatcggctggtggccgcaacgcatggtgaccttcgtcgacaaccatgacacgggcccgagcaatcactgtggtgacggccagaacctctggcccgtgccctgtgacaaggtcatggaggcgtatgcctacatcctgacccatccgggcgtgccgtcggtgtactggacgcacttcttcaactggaatcttggtagcgagatcagccagttgatgcagatccgcaagaaccagggcgtgcactccggttccgacgtctggatcgccgaggcccgtcacggcctgtacgccgcctatatcaacggtaatgtggcgatgaagatgggctgggataactggagcccgggctggggctggtcgctggcggcctccggtaacaactgggccgtctggacacgctga

SEQ ID NO: 212 - protein, 496 aa, Environmental
VFRSDTVSRTCMYGALRNAYQPDRVFTGVTVRTCNLKKHAHRQALLFIVTRCLCLKSRQTHKNNNKPITNDPSLLRGENGMAFKLRKKALVGLFTAGAMVYAGAAASGEIILQGFHWHSKWGGNNQGWWQVMEGQANTIANAGFTHVWFPPVHNSADAEGYLPRELNNLNSSYGSEAQLRSAIQALNNRGVHAIADVVMNHRVGCSGWADFCNPDWPTWYIVANDSWPGGPKSQNWDTGETYHAARDLDHANPQVRNDISHYLNSRLKDVGFSGWRWDYAKGFWPGYVGEYNWNTNPNFCVGEVWDDLDPNNPNPHRQQLVDWVDATGGSCHVFDFTTKGLTNYALQHGQYWRLQGDNGGPAGGIGWWPQRMVTFVDNHDTGPSNHCGDGQNLWPVPCDKVMEAYAYILTHPGVPSVYWTHFFNWNLGSEISQLMQIRKNQGVHSGSDVWIAEARHGLYAAYINGNVAMKMGWDNWSPGWGWSLAASGNNWAVWTR

SEQ ID NO: 213 - protein, 23 aa, Environmental
MFLLAFLLTASLFCPTGQPAKAA

SEQ ID NO: 214 - protein, 23 aa, Bacterial
VLTFHRIIRKGWMFLLAFLLTAS

SEQ ID NO: 215 - protein, 33 aa, Bacterial
MKSFAFMPILFYANDFISEREGGGKMGKNMRRR

SEQ ID NO: 216 - protein, 31 aa, Bacterical
MRKKMSHSRFTFLLILALFIFFSGCISEVKS

SEQ ID NO: 217 - protein, 30 aa, Bacterial
MYTLFIRSFYDTNNDGVGDYNGVAQKVDYL

SEQ ID NO: 218 - protein, 22 aa, Environmental
VLTFHRIIRKGWMFLLAFLLTA

SEQ ID NO: 219 - protein, 33 aa, Environmental
MSLFKKIFPWIVSLLLLFSFIAPFSIQTEKVRA

SEQ ID NO: 220 - protein, 25 aa, Environmental
MARKTLAIFFVLLVLLSLSAVPAKA

SEQ ID NO: 221 - protein, 35 aa, Environmental
MPAFKSKVMHMKLKYLALVLLAVASIGLLSTPVGA

SEQ ID NO: 222 - protein, 28 aa, Environmental
MKQQKRLYARLLTLLFALIFLLPHSAAA

SEQ ID NO: 223 - protein, 21 aa, Environmental
MRVFLVVPKLSRPFQAESQQQ

SEQ ID NO: 224 - protein, 30 aa, Bacterial
MQTFAFLFYSKKGWVCMNYLKKVWLYYAIV

SEQ ID NO: 225 - protein, 35 aa, Environmental
MPQAIRTFSRWTLFGLIGVFLLGLVFSVPPRAIQA

SEQ ID NO: 226 - protein, 28 aa, Environmental
VVHMKLKYLALVLLAVASIGLLSTPVGA

SEQ ID NO: 227 - protein, 30 aa, Environmental
VCMNYLKKVWLYYAIVATLIIYFLTPFSTA

SEQ ID NO: 228 - protein, 30 aa, Environmental
MPQLYPLPPRWRRAARQGLAALTLATTALG

SEQ ID NO: 229 - protein, 30 aa, Environmental
MNNVKKVWLYYSIIATLVISFFTPFSTAQA

SEQ ID NO: 230 - protein, 28 aa, Environmental
VGRAGLAHHSNTSAKGTYGSPLELRPDR

SEQ ID NO: 231 - protein, 23 aa, Environmental
MKTFNLKPTLLPLTLLLSSPVLA

SEQ ID NO: 232 - protein, 23 aa, Environmental
MKPINTLLISALAVCSFSSATYA

SEQ ID NO: 233 - protein, 30 aa, Environmental
MPKSTFTKSITKSLLATSVVVSLLPAYAQA

SEQ ID NO: 234 - protein, 27 aa, Environmental
MLKRITVVCLLFILLFPNIYGRNKAEA

SEQ ID NO: 235 - protein, 29 aa, Environmental
MSLNNFKVKLLSFAVSSAVLSLAPNLANA

SEQ ID NO: 236 - protein, 28 aa, Environmental
MILSNFKVKLLSFAVSSAVLTLAANVAN

SEQ ID NO: 237 - protein, 27 aa, Environmental
MLKRITVVCLLFILLFPNIYEGNKAEA

SEQ ID NO: 238 - protein, 26 aa, Environmental
MPSINASDCKKKGDRSMKRKKWTALA

SEQ ID NO: 239 - protein, 33 aa, Environmental
VSRMFAKRFKTSLLPLFAGFLLLFHLVLAGPTA

SEQ ID NO: 240 - protein, 25 aa, Environmental
MQTIAKKGDETMKGKKWTALALTLP

SEQ ID NO: 241 - protein, 25 aa, Environmental
MQKKGDETMKGKKWTALALTLPLAA

SEQ ID NO: 242 - protein, 36 aa, Bacterical
VDPKNCSQFMQTIAKKGDETMKGKKWTALALTLPLA

SEQ ID NO: 243 - protein, 36 aa, Environmental
MQTIAKKGDETMKGKKWTALALTLPLAASLSTGVHA

SEQ ID NO: 244 - protein, 23 aa, Environmental
MKTFKLKRTFLPLTLLLSAPAFA

SEQ ID NO: 245 - protein, 25 aa, Environmental
MQTIAKKGDETMKGKKWTALALTLP

SEQ ID NO: 246 - protein, 22 aa, Environmental
MKNIIRLCAASAILTVSHASYA

SEQ ID NO: 247 - protein, 23 aa, Environmental
MKTFKLKRTFLPLTLLLSAPAFA

SEQ ID NO: 248 - protein, 23 aa, Environmental
MKTFKLKRTFLPLTLLLSAPAFA

SEQ ID NO: 249 - protein, 25 aa, Environmental
MKLMKGKKWTALALTLPLAASLSTG

SEQ ID NO: 250 - protein, 36 aa, Environmental; identical to SEQ ID NO: 243

SEQ ID NO: 251 - protein, 25 aa, Environmental
MQTIAKKGDETMKGKKWTALALTLP

SEQ ID NO: 252 - protein, 25 aa, Environmental
MKFKKSLSAGLLLFGGLSGVTPSVA

SEQ ID NO: 253 - protein, 23 aa, Environmental
MKPSKFVFLSAAIACSLSSTANA

SEQ ID NO: 254 - protein, 23 aa, Environmental
VSLTKKAQYEPNTAPRLSTSLQS

SEQ ID NO: 255 - protein, 30 aa, Environmental
MTAKADDLRIYQIMVESFVDGDKQVGHGTG

SEQ ID NO: 256 - protein, 25 aa, Environmental
MKMKSRAWLLGSAVAMALASSAANA

SEQ ID NO: 257 - protein, 16 aa, Environmental
MYRVIPIILIMSMIVA

SEQ ID NO: 258 - DNA, 47 bp, Artificial Sequence
  primer
gaacactagtaggaggtaacttatggcaaagtattccgagctcgaag

SEQ ID NO: 259 - DNA, 39 bp, Artificial Sequence
  primer
gaacggtctcattccgccagccagcaaggggatgagcgg

SEQ ID NO: 260 - DNA, 33 bp, Artificial Sequence
  primer
gaaccgtctcaaaacacggcccatgcctacggc

SEQ ID NO: 261 - DNA, 38 bp, Artificial Sequence
  primer
gaacgtctcacctcgacttccaccccaacgaggtcaag

SEQ ID NO: 262 - DNA, 33 bp, Artificial Sequence
  primer
gaacgtctcaggcgctttgactacgtgaagggc

SEQ ID NO: 263 - DNA, 32 bp, Artificial Sequence
  primer
gaacggtctcaacaagatggatgaggcctttg

SEQ ID NO: 264 - DNA, 38 bp, Artificial Sequence
  primer
gaaccgtctcacgatataatctggaacaagtaccttgc

SEQ ID NO: 265 - DNA, 35 bp, Artificial Sequence
  primer
gaaccgtctcagaagcacgagcatagtttactacg

SEQ ID NO: 266 - DNA, 30 bp, Artificial Sequence
  primer
gaaccgtctcaaaggtgggtttatgtgccg

SEQ ID NO: 267 - DNA, 36 bp, Artificial Sequence
  primer
gaacgtctcaggaatccaaatggcggatattcccgc

SEQ ID NO: 268 - DNA, 33 bp, Artificial Sequence
  primer
gaacggtctcagtttatcatattgatgagctcc

SEQ ID NO: 269 - DNA, 33 bp, Artificial Sequence
  primer
gaaccgtctcagaggtagttggcagtatatttg

SEQ ID NO: 270 - DNA, 31 bp, Artificial Sequence
  primer
gaacgtctcacgccaggcatcaacgccgatg

SEQ ID NO: 271 - DNA, 30 bp, Artificial Sequence
  primer
gaacgtctcattgtagtagagcgggaagtc

SEQ ID NO: 272 - DNA, 32 bp, Artificial Sequence
  primer
gaacggtctcaatcggtgtcgtggtttgctac

SEQ ID NO: 273 - DNA, 31 bp, Artificial Sequence
  primer
gaaccgtctcacttccacctgcgaggtggtc

SEQ ID NO: 274 - DNA, 31 bp, Artificial Sequence
  primer
gaaccgtctcaccttccaaccttgctcgagc

SEQ ID NO: 275 - DNA, 33 bp, Artificial Sequence
  primer
tcgagactgactctcacccaacaccgcaatagc

SEQ ID NO: 276 - DNA, 50 bp, Artificial Sequence
  primer
gaacactagtaggaggtaacttatggccaagtacctggagctcgaagagg

SEQ ID NO: 277 - DNA, 31 bp, Artificial Sequence
  primer
gaacggtctcattcccccggcgagcaagggc

SEQ ID NO: 278 - DNA, 32 bp, Artificial Sequence
  primer
gaaccgtctcaaaacaccgcccacgcctacgg

SEQ ID NO: 279 - DNA, 29 bp, Artificial Sequence
  primer
gaacgtctcacctcgacttccaccccaac

SEQ ID NO: 280 - DNA, 31 bp, Artificial Sequence
  primer
gaacgtctcaggcgcttcgactacgtcaagg

SEQ ID NO: 281 - DNA, 34 bp, Artificial Sequence
  primer
gaacggtctcaacaagatggacgcggcctttgac

SEQ ID NO: 282 - DNA, 35 bp, Artificial Sequence
  primer
gaaccgtctcacgatataatttggaacaagtaccc

SEQ ID NO: 283 - DNA, 31 bp, Artificial Sequence
  primer
gaaccgtctcagaagcaccgacatagtctac

SEQ ID NO: 284 - DNA, 30 bp, Artificial Sequence
  primer
gaaccgtctcaaaggtgggtctacgttccg

SEQ ID NO: 285 - DNA, 36 bp, Artificial Sequence
  primer
gaacgtctcaggaatccatattgcggagattccggc

SEQ ID NO: 286 - DNA, 32 bp, Artificial Sequence
  primer
gaacggtctcagtttatcatgttcacgagctc

SEQ ID NO: 287 - DNA, 33 bp, Artificial Sequence
  primer
gaaccgtctcagaggtagttggccgtgtacttg

SEQ ID NO: 288 - DNA, 30 bp, Artificial Sequence
  primer
gaacgtctcagccatgcgtcaacgccgatg

SEQ ID NO: 289 - DNA, 31 bp, Artificial Sequence
  primer
gaacgtctcattgtagtagagcgggaagtcg

SEQ ID NO: 290 - DNA, 33 bp, Artificial Sequence
  primer
gaacggtctcaatcggtgtcgtggtttgcaacg

SEQ ID NO: 291 - DNA, 34 bp, Artificial Sequence
  primer
gaaccgtctcacttccaccggcgaggtggtcgtg

SEQ ID NO: 292 - DNA, 32 bp, Artificial Sequence
  primer
gaaccgtctcaccttccggccttgctcgagcc

SEQ ID NO: 293 - DNA, 35 bp, Artificial Sequence
  primer
tcgagactgactctcagcccaccccgcagtagctc

SEQ ID NO: 294 - DNA, 50 bp, Artificial Sequence
  primer
gaacactagtaggaggtaacttatggccaagtactccgagctggaagagg

SEQ ID NO: 295 - DNA, 30 bp, Artificial Sequence
  primer
gaacggtctcattcctcccgcgagcaaggg

SEQ ID NO: 296 - DNA, 31 bp, Artificial Sequence
  primer
gaaccgtctcaaaacaccgcccacgcctatg

SEQ ID NO: 297 - DNA, 33 bp, Artificial Sequence
  primer
gaacgtctcacctcgacttccacccgaacgagc

SEQ ID NO: 298 - DNA, 31 bp, Artificial Sequence; identical to SEQ ID NO: 280
  primer

SEQ ID NO: 299 - DNA, 32 bp, Artificial Sequence
  primer
gaacggtctcaacaagatggacgaggccttcg

SEQ ID NO: 300 - DNA, 30 bp, Artificial Sequence
  primer
gaaccgtctcacgatataatctggaacaag

SEQ ID NO: 301 - DNA, 35 bp, Artificial Sequence
  primer
gaaccgtctcagaagcactgacatcgtttactacg

SEQ ID NO: 302 - DNA, 30 bp, Artificial Sequence
  primer
gaaccgtctcaaaggtgggtttacgttccg

SEQ ID NO: 303 - DNA, 30 bp, Artificial Sequence
  primer
gaacgtctcaggaatccatatcgccgaaat

SEQ ID NO: 304 - DNA, 30 bp, Artificial Sequence
  primer
gaacggtctcagtttatcatgtttatgagc

SEQ ID NO: 305 - DNA, 34 bp, Artificial Sequence
  primer
gaaccgtctcagaggtagttggccgtgtatttac

SEQ ID NO: 306 - DNA, 30 bp, Artificial Sequence
  primer
gaacgtctcacgccaggcatcgatgccgat

SEQ ID NO: 307 - DNA, 34 bp, Artificial Sequence
  primer
gaacgtctcattgtagtagagggcgaagtcaaag

SEQ ID NO: 308 - DNA, 36 bp, Artificial Sequence
  primer
gaacggtctcaatcggtatcgtggttggctacaaac

SEQ ID NO: 309 - DNA, 34 bp, Artificial Sequence
  primer
gaaccgtctcacttcctccggcgaggttgtcatg

SEQ ID NO: 310 - DNA, 32 bp, Artificial Sequence
  primer
gaaccgtctcaccttccggctttgcttgaggc

SEQ ID NO: 311 - DNA, 36 bp, Artificial Sequence
  primer
tcgagactgactctcacccaacaccgcagtagctcc

SEQ ID NO: 312 - DNA, 38 bp, Artificial Sequence
  primer
cacacagcagcaaccaacctcgagactgactctcascc

SEQ ID NO: 313 - protein, 461 aa, Pyrococcus sp.
MKKFVALLITMFFVVSMAAVAQPASAAKYSELEEGGVIMQAFYWDVPAGGIWWDTIRSKIPEWYEAGISAIWIPPASKGMGGAYSMGYDPYDFFDLGEYNQKGTVETRFGSKQELINMINTAHAYGIKVIADIVINHRAGGDLEWNPFVGDYTWTDFSKVASGKYTANYLDFHPNEVKCCDEGTFGGFPDIAHEKEWDQHWLWASDESYAAYLRSIGVDAWRFDYVKGYGAWVVKDWLNWWGGWAVGEYWDTNVDALLNWAYSSGAKVFDFPLYYKMDEAFDNTNIPALVDALQNGGTVVSRDPFKAVTFVANHDTDIIWNKYPAYAFILTYEGQPVIFYRDYEEWLNKDKLNNLIWIHDHLAGGSTSIVYYDSDELIFVRNGDSKRPGLITYINLGSSKVGRWVYVPKFAGACIHEYTGNLGGWVDKYVESSGWVYLEAPAYDPASGQYGYTVWSYCGVG

SEQ ID NO: 314 - protein, 460 aa, Pyrococcus furiosus
VNIKKLTPLLTLLLFFIVLASPVSAAKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 315 - protein, 484 aa, Thermococcus sp.
SESQCTATCTWRVVYMSAKKLLALLFVLAVLVGVAVIPARVGIAPVSAGATSRPSLEEGGVIMQAFYWDVPAGGIWWDTIRSKIPDWASAGISAIWIPPASKGMSGAYSMGYDPYDFFDLGEYYQKGTVETRFGSKQELINMINTAHSYGIKVIADIVINHRAGGDLEWNPFTNSYTWTDFSKVASGKYTANYLDFHPNEVKCCDEGTFGGFPDIAHEKSWDQYWLWASQKSYAAYLRSIGIDAWRFDYVKGYGAWVVKDWLKWWALAVGEYWDTNVDALLNWAYSSGAKVFDFPLYYKMDEAFDNKNIPALVSALQNGQTVVSRDPFKAVTFVANHDTDIIWNKYPAYAFILTYEGQPVIFYRDYEEWLNKDRLKNLIWIHNNLAGGSTSIVYYDNDELIFVRNGYGNKPGLITYINLGSSKVGRWVYVPKFAGSCIHEYTGNLGGWVDKYVGSNGWVYLEAPAHDPAKGQYGYSVWSYCGVG

SEQ ID NO: 316 - protein, 457 aa, Thermococcus hydrothermalis
MARKVLVALLVFLVVLSVSAVPAKAETLENGGVIMQAFYWDVPGGGIWWDTIAQKIPDWASAGISAIWIPPASKGMSGGYSMGYDPYDFFDLGEYYQKGSVETRFGSKEELVNMINTAHAHNMKVIADIVINHRAGGDLEWNPFTNSYTWTDFSKVASGKYTANYLDFHPNELHAGDSGTFGGYPDICHDKSWDQHWLWASNESYAAYLRSIGIDAWRFDYVKGYAPWVVKNWLNRWGGWAVGEYWDTNVDALLSWAYDSGAKVFDFPLYYKMDEAFDNNNIPALVDALKNGGTVVSRDPFKAVTFVANHDTNIIWNKYPAYAFILTYEGQPAIFYRDYEEWLNKDRLRNLIWIHDHLAGGSTDIIYYDSDELIFVRNGYGDKPGLITYINLGSSKAGRWVYVPKFAGSCIHEYTGNLGGWIDKWVDSSGRVYLEAPAHDPANGQYGYSVWSYCGVG

SEQ ID NO: 317 - protein, 340 aa, Artificial Sequence
  consensus sequence
SALEGGVIMQAFYWDVPGGIWWDIKIPWAGISAIWPPSKGMGYSMGYDPYDFDLGEYQKGETRFGSKELITAHKVIADVINHRAGGDLEWNPFYTWTDFSKVASGKYTANYLDFHPNEDGTFGGPDIHKWDQWLWSSYAAYLRSIGDWRFDYVKGYWVVWLWAVGEYWDTNVDALLWAYSGAKVFDFPLYYKMDEAFDNNIPALVALNGTVVSRDPFKAVTFVANHDTIIWNKYAYAFILTYEGQPIFYRDEEWLNKDLNLIWIHLAGGSTIYYDDEIFVRNGPGLITYINLGRWVYVPKFAGCIHEYTGNLGGWDKVSGVYEAPDPAGYGYVWSYCGVG

SEQ ID NO: 318 - protein, 463 aa, Artificial Sequence
  clone
MRRSARVLVLIIAFFLLAGIYYPSTSAAKYSELEQGGVIMQAFYWDVPEGGIWWDTIRQKIPEWYDAGISAIWIPPASKGMGGAYSMGYDPYDYFDLGEFYQKGTVETRFGSKEELVNMISTAHQYGIKVIADIVINHRAGGDLEWNPYVGDYTWTDFSKVASGKYKAHYMDFHPNNYSTSDEGTFGGFPDIDHLVPFNQYWLWASNESYAAYLRSIGIDAWRFDYVKGYGAWVVKDWLSQWGGWAVGEYWDTNVDALLNWAYSSGAKVFDFPLYYKMDEAFDNKNIPALVYAIQNGETVVSRDPFKAVTFVANHDTNIIWNKYPAYAFILTYEGQPVIFYRDYEEWLNKDKLNNLIWIHEHLAGGSTKILYYDDDELIFMREGYGDRPGLITYINLGSDWAERWVNVGSKFAGYTIHEYTGNLGGWVDRYVQYDGWVKLTAPPHDPANGYYGYSVWSYAGVG

SEQ ID NO: 319 - protein, 306 aa, Artificial Sequence
  consensus sequence
GGIMQAFYWDVPGGIWWDIKIPWAGISAIWPPSKGMGYSMGYDPYDFDLGEQKGETRFGSKELITAHKVIADVINHRAGGLEWNPYTWTDFSKVASGKYAYDFHPNDGTFGGPDIHQWLWSSYAAYLRSIGDWFDYVKGYWVVWLWAVGEYWDTNVDALWAYSAKVFDFLYYKMDAFDNNIPALVAGTVVSRDPFKAVTFVANHDTIIWNKYAYAFILTYEGQPIFYRDEEWLNKDLNLIWIHLAGGSTIYYDDEIFRGPGLITYINLRWVVKFAGIHEYTGLGGWDVGVAPDPAGYGYVWSYGVG

SEQ ID NO: 320 - DNA, 1392 bp, Artificial Sequence
  clone
atgaggagatccgcaagggttttggttctgattatagcgtttttcctcctggcggggatttactacccctccacgagtgccgcgaagtactccgagctggagcagggcggagtcataatgcaggccttctactgggacgttccggagggaggaatctggtgggacacaatacggcagaagatccctgaatggtacgatgcaggcatatccgccatctggatacccccggcgagcaagggcatgggcggggcctactcgatgggctacgacccctacgattacttcgatctgggcgagttttaccagaagggaaccgttgagacccgcttcggctccaaggaagagctcgtcaacatgatctccacggcccaccagtacggcatcaaggttatagcggacatagtgataaaccaccgcgcaggtggagacctcgaatggaacccatacgtcggcgactatacctggacggacttttctaaggtcgcctccgggaaatacaaggcccactacatggacttccatccaaacaactacagcacctcagacgagggaaccttcggtggcttcccagacattgatcacctcgtgcccttcaaccagtactggctgtgggcgagcaacgagagctacgccgcctacctcaggagcatagggatcgatgcgtggcgctttgactacgttaagggctacggcgcgtgggtcgtcaaggactggctgagtcagtggggcggctgggccgtcggcgagtactgggacaccaacgtcgatgcgctcctcaactgggcctacagcagcggcgccaaggtcttcgacttcccgctctactacaagatggacgaggcctttgacaacaagaacattcccgccctcgtttacgccatccagaacggtgaaaccgtcgtcagcagggatcccttcaaggccgttaccttcgtggctaaccacgatacgaacataatctggaacaagtaccctgcctatgccttcatcctgacctacgaaggtcagcccgtcatcttctaccgcgactacgaggagtggctcaacaaggacaaactcaacaacctcatatggattcacgagcacctggcagggggaagcaccaagatcctctactacgacgacgatgagctcatcttcatgagggaaggctacggcgacaggcccgggcttataacctacatcaacctcggtagcgactgggcggagagatgggtgaacgttggctcaaagttcgcgggctatacaatccacgaatacaccggaaacctcggcggctgggtcgacaggtacgtccagtacgacggctgggtcaagcttaccgctccgccacacgatccggcaaacggctattacggctactcggtctggagctacgccggagttggatga

SEQ ID NO: 321 - DNA, 846 bp, Artificial Sequence
  consensus sequence
ggcggtataatgcaggcttctatgggagtccggaggaattggtgggacacataagatccgatgggcggattcgcattggatccccgcagaagggatggcgggtatcatgggctacgaccctacgatttgactgggagtacagaagggatgaacgttggtcaaagacttaaatgatcacgccaacataaggtatgcgaatgtataaccaccgcgcgggggctgatggaacctcctaacctggacgatttcaagtgctcggaataagccactactgacttccaccaacagaggacttggggtccgaatcacctaccagactggcttgggcagcgaagctacgcgctactggagcatggtgagctgggttgactacgtaagggctagctgggtgtaactggctgtggggggctgggcgtgggagtactgggacacaacgtgagctctactgggctacagcggcaagtcttgacttccctctactacaagatggaggccttgaaaaaacatccgctgtgctaggacgtgtccggaccttaagcgtacttgtgcaaccacgaacaataattggaacaagtacgctagcttcatcctacctagaggcagccattttaccgcgactacgaggagtggctcaacaaggaataaacctcattggatcagaacctgcggggagacatttactacgacgagatattttagaggctaggcaccggctataactaatcaacctgcggagtgggtagtcaagttcgcggatcacgataacggactcggggtggtgacagtgttcgggggtatgccccacgaccgcaaggataggctactcgttggagctacgggtggtga

What is claimed is:

1. An isolated, synthetic or recombinant nucleic acid comprising:
   (a) a nucleic acid sequence encoding a polypeptide having alpha amylase activity, wherein the nucleic acid sequence has at least 95% sequence identity to the sequence of SEQ ID NO:125,
   (b) a nucleic acid sequence encoding a polypeptide having alpha amylase activity, wherein the polypeptide comprises (i) an amino acid sequence having at least 95% sequence identity to the sequence of SEQ ID NO:126, or (ii) enzymatically active fragments of (i);
   (c) the nucleic acid of (a) or (b) encoding a polypeptide having at least one conservative amino acid substitution as compared to the polypeptide encoded by (a) or (b), wherein the conservative amino acid substitutions comprise: replacement of an aliphatic amino acid with another aliphatic amino acid; replacement of a Serine with a Threonine or vice versa; replacement of an acidic residue with another acidic residue; replacement of a residue bearing an amide group with another residue bearing an amide group; exchange of a basic residue with another basic residue; or replacement of an aromatic residue with another aromatic residue;
   (d) the nucleic acid of (a), (b) or (c) encoding a polypeptide lacking a signal sequence;
   (e) the nucleic acid of (a), (b), (c) or (d) further comprising a heterologous sequence;
   (f) the nucleic acid of (e), wherein the heterologous sequence comprises a sequence encoding a heterologous signal sequence;
   (g) the nucleic acid of (e), wherein the heterologous sequence comprises a sequence encoding an N-terminal identification peptide; or
   (h) sequences completely complementary to (a), (b), (c), (d), (e), (f) or (g).

2. The isolated, synthetic or recombinant nucleic acid of claim 1, wherein the sequence identity of (a) or (b) is at least 97%.

3. The isolated, synthetic or recombinant nucleic acid of claim 1, wherein the sequence identity of (a) or (b) is at least 98%.

4. The isolated, synthetic or recombinant nucleic acid of claim 1, wherein the sequence identity of (a) or (b) is at least 99%.

5. A nucleic acid probe for identifying or isolating an amylase-encoding gene, comprising the nucleic acid of claim 1.

6. The nucleic acid probe of claim 5, wherein the nucleic acid comprises DNA or RNA.

7. The nucleic acid probe of claim 5, wherein the probe further comprises a detectable isotopic label.

8. The nucleic acid probe of claim 5, wherein the probe further comprises a detectable non-isotopic label selected from the group consisting of a fluorescent molecule, a chemiluminescent molecule, an enzyme, a cofactor, an enzyme substrate, and a hapten.

9. A cloning or expression vector comprising a sequence that encodes a polypeptide having alpha amylase activity, said sequence comprising the nucleic acid sequence of claim 1.

10. The cloning or expression vector of claim 9, wherein the vector is selected from the group consisting of viral vectors, plasmid vectors, phage vectors, phagemid vectors, cosmids, fosmids, bacteriophages, artificial chromosomes, adenovirus vectors, retroviral vectors, and adeno-associated viral vectors.

11. An isolated or cultured host cell comprising a nucleic acid having a sequence that encodes a polypeptide having alpha amylase activity, said sequence comprising the nucleic acid sequence of claim 1.

12. A method of producing a polypeptide having amylase activity, comprising the steps of: providing the amylase-encoding nucleic acid of claim 1; and introducing the nucleic acid encoding the polypeptide, operably linked to a promoter, into a host cell under conditions that allow expression of the polypeptide.

13. A method of producing a polypeptide encoded by the nucleic acid of claim 1, comprising the steps of introducing the nucleic acid encoding the polypeptide into a host cell under conditions that allow expression of the polypeptide, wherein the expressed polypeptide has alpha amylase activity.

14. A method for producing a feed or food comprising a recombinant amylase, the method comprising the steps of:
   (a) providing the amylase encoding nucleic acid of claim 1;
   (b) providing a composition comprising a feed or food;
   (c) expressing the nucleic acid to produce a recombinant amylase; and
   (d) mixing the recombinant amylase and the feed-comprising or food-comprising composition, thereby producing a feed or food comprising a recombinant amylase.

15. An isolated, synthetic or recombinant nucleic acid that hybridizes under stringent conditions to SEQ ID NO:125, or its complement, wherein the nucleic acid comprises a sequence selected from the group consisting of:
   (a) a nucleic acid sequence encoding a polypeptide having alpha amylase activity, wherein the nucleic acid sequence has at least 90% sequence identity to the sequence of SEQ ID NO:125, or its complement;
   (b) a nucleic acid sequence (i) encoding a polypeptide having alpha amylase activity, wherein the polypeptide comprises (A) an amino acid sequence having at least 90% sequence identity to the sequence of SEQ ID NO:126, or (B) enzymatically active fragments of (A), or (ii) completely complementary to (i);
   (c) the nucleic acid of (a) or (b) encoding a polypeptide lacking a signal sequence;
   (d) the nucleic acid of (a), (b) or (c) further comprising a heterologous sequence;
   (e) the nucleic acid of (d), wherein the heterologous sequence comprises a sequence encoding a heterologous signal sequence;
   (f) the nucleic acid of (e), wherein the heterologous sequence comprises a sequence encoding an N-terminal identification peptide; and
   (g) sequences completely complementary to (a), (b), (c), (d), (e) or (f);
   wherein the stringent conditions comprise a wash step comprising 30 minutes at room temperature in a solution comprising 150 mM NaCl, 20 mM Tris hydrochloride, pH 7.8, 1 mM Na2EDTA, 0.5% SDS, followed by a 30 minute wash in fresh solution at Tm−10° C.

16. The isolated, synthetic or recombinant nucleic acid of claim 15, wherein the nucleic acid sequence identity is determined by using a method comprising use of a BLASTN program algorithm with default parameters or the polypeptide sequence identity is determined by using a method comprising use of a BLAST P program algorithm with default parameters.

17. The isolated, synthetic or recombinant nucleic acid of claim 15, wherein the sequence identity is determined using a sequence comparison algorithm comprising FASTA version 3.0t78 with the default parameters.

18. The isolated, synthetic or recombinant nucleic acid of claim 15, wherein the sequence identity of (a) or (b) is at least 95%.

19. The isolated, synthetic or recombinant nucleic acid of claim 15, wherein the sequence identity in (a) or (b) is 97%.

20. The isolated, synthetic or recombinant nucleic acid of claim 19, wherein the sequence identity in (a) or (b) is 98%.

21. The isolated, synthetic or recombinant nucleic acid of claim 20, wherein the sequence in (a) is SEQ ID NO:125, and the sequence in (b) is SEQ ID NO:126.

22. A probe comprising the nucleic acid of claim 15.

23. A vector comprising a nucleic acid that encodes a polypeptide having alpha amylase activity, said nucleic acid comprising the nucleic acid of claim 15.

24. The vector of claim 23, wherein the vector is selected from the group consisting of viral vectors, plasmid vectors, phage vectors, phagemid vectors, cosmids, fosmids, bacteriophages, artificial chromosomes, adenovirus vectors, retroviral vectors, and adeno-associated viral vectors.

25. An expression or cloning vector comprising the nucleic acid of claim 15.

26. An isolated or cultured host cell comprising a nucleic acid that encodes a polypeptide having alpha amylase activity, said nucleic acid comprising the nucleic acid of claim 15.

27. The isolated or cultured host cell of claim 26, wherein the host is selected from the group consisting of prokaryotes, eukaryotes, funguses, yeasts, and plants.

28. An isolated or cultured host cell comprising the vector of claim 23.

29. A method of producing a polypeptide encoded by the nucleic acid of claim 15, comprising the steps of introducing a nucleic acid encoding the polypeptide into a host cell under conditions that allow expression of the polypeptide, wherein the expressed polypeptide has alpha amylase activity.

30. A method for producing a feed or food comprising a recombinant amylase, the method comprising the steps of:
   (a) providing the amylase-encoding nucleic acid of claim 15;
   (b) providing a composition comprising a feed or food;
   (c) expressing the nucleic acid to produce a recombinant amylase; and
   (d) mixing the recombinant amylase and the feed-comprising or food-comprising composition, thereby producing a feed or food comprising a recombinant amylase.

31. An isolated, synthetic or recombinant nucleic acid encoding a polypeptide having alpha amylase activity that hybridizes under stringent conditions to a sequence selected from the group consisting of: (a) the sequence of SEQ ID NO:125; (b) sequences completely complementary to (a);
   wherein the stringent conditions comprise a wash step comprising 30 minutes at room temperature in a solution comprising 150 mM NaCl, 20 mM Tris hydrochloride, pH 7.8, 1 mM Na2EDTA, 0.5% SDS, followed by a 30 minute wash in fresh solution at Tm−10° C., and wherein the sequence encodes a polypeptide having alpha amylase activity.

32. The isolated, synthetic or recombinant nucleic acid of claim 15 or claim 31, wherein the Tm=81.5+16.6(log [Na+])+0.41(fraction G+C)−(0.63% formamide) −(600/N) where N is the length of the nucleic acid.

33. A method for producing a feed or food comprising a recombinant amylase, the method comprising:
   (a) providing a nucleic acid comprising the nucleic acid of claim 31;
   (b) providing a composition comprising a feed or food;
   (c) expressing the nucleic acid to produce a recombinant amylase; and (d) mixing the recombinant amylase and the feed-comprising or food-comprising composition, thereby producing a feed or food comprising a recombinant amylase.

34. A method of producing a polypeptide having (i) an amino acid sequence having at least 95% sequence identity to the amino acid sequence of SEQ ID NO:126, or (ii) enzymatically active fragments of (i), comprising the steps of introducing a nucleic acid encoding the polypeptide into a host cell under conditions that allow expression of the polypeptide, wherein the expressed polypeptide has alpha amylase activity.

35. The method of claim 34, wherein the polypeptide sequence identity is determined by using a method comprising use of a BLAST P algorithm with default parameters.

36. The method of claim 34, wherein the method produces a polypeptide having (i) an amino acid sequence having at least 97% sequence identity to the amino acid sequence of SEQ ID NO:126, or (ii) enzymatically active fragments of (i).

* * * * *